US011919945B2

(12) United States Patent
Nussenzweig

(10) Patent No.: US 11,919,945 B2
(45) Date of Patent: Mar. 5, 2024

(54) NEUTRALIZING ANTI-SARS-COV-2 ANTIBODIES

(71) Applicant: The Rockefeller University, New York, NY (US)

(72) Inventor: Michel Nussenzweig, New York, NY (US)

(73) Assignee: The Rockefeller University, New York, NY (US)

( * ) Notice: Subject to any disclaimer, the term of this patent is extended or adjusted under 35 U.S.C. 154(b) by 61 days.

(21) Appl. No.: 17/519,173

(22) Filed: Nov. 4, 2021

(65) Prior Publication Data

US 2022/0195015 A1 Jun. 23, 2022

Related U.S. Application Data

(60) Provisional application No. 63/109,567, filed on Nov. 4, 2020.

(51) Int. Cl.

| | |
|---|---|
| ***C07K 16/10*** | (2006.01) |
| ***A61P 31/14*** | (2006.01) |
| ***A61K 39/42*** | (2006.01) |
| ***G01N 33/569*** | (2006.01) |
| ***A61K 39/00*** | (2006.01) |

(52) U.S. Cl.

CPC .............. *C07K 16/10* (2013.01); *A61K 39/42* (2013.01); *A61P 31/14* (2018.01); *G01N 33/56983* (2013.01); *A61K 2039/505* (2013.01); *C07K 2317/21* (2013.01); *C07K 2317/31* (2013.01); *C07K 2317/34* (2013.01); *C07K 2317/76* (2013.01); *C07K 2317/92* (2013.01); *G01N 2333/165* (2013.01)

(58) Field of Classification Search

CPC ...................................................... C07K 16/10

See application file for complete search history.

(56) References Cited

U.S. PATENT DOCUMENTS

| | | | |
|---|---|---|---|
| 10,787,501 B1 * | 9/2020 | Babb ...................... | C07K 16/10 |
| 2021/0332110 A1 | 10/2021 | Nussenzweig et al. | |

OTHER PUBLICATIONS

U.S. Appl. No. 17/575,246, filed Jan. 2022, Rockefellar University.*

U.S. Appl. No. 18/305,937, filed Apr. 2023, Rockefellar University.*

McCarthy et al. (J. Immunol. Methods, 251(1-2): 137-149, 2001) (Year: 2001).*

Vardanyan, R, et al, Antiviral Drugs. Synthesis of Best-Seller Drugs. 2016:687-736. doi: 10.1016/B978-0-12-411492-0.00034-1. Epub Feb. 19, 2016. PMCID: PMC7149618 (Year: 2016).*

Yu, Fei et al: "Receptor-binding domain-specific human neutralizing monoclonal antibodies against SARS-CoV and SARS-CoV-2", Signal Transduction and Targeted Therapy, vol. 5, No. 1, Sep. 22, 2020 (Sep. 22, 2020), 12 pages.

Hansen, Johanna et al: "Studies in humanized mice and convalescent humans yield a SARS-CoV-2 antibody cocktail", Science, vol. 369, No. 6506, Aug. 21, 2020 (Aug. 21, 2020), pp. 1010-1014.

Hansen, Johanna et al: "Supplementary Materials:Studies in humanized mice and convalescent humans yield a SARS-CoV-2 antibody cocktail;", Science, vol. 369, No. 6506, Jun. 15, 2020 (Jun. 15, 2020), pp. 1-30.

Baum, Alina et al: "Antibody cocktail to SARS-CoV-2 spike protein prevents rapid mutational escape seen with individual antibodies", Science, Jun. 15, 2020 (Jun. 15, 2020), eabd0831, 8 pages.

Robbiani, Davide F et al: "Convergent antibody responses to SARS-CoV-2 in convalescent individuals", Nature, vol. 584, No. 7821, Jun. 18, 2020 (Jun. 18, 2020), pp. 437-442.

Rudikoff Set al: "Single amino acid substitution altering antigen-binding specificity", Proceedings of the National Academy of Sciences, National Academy of Sciences, vol. 79, No. 6, Mar. 1, 1982 (Mar. 1, 1982), pp. 1979-1983.

Dondelinger, Mathieu et al: "Understanding the Significance and Implications of Antibody Numbering and Antigen-Binding Surface/Residue Definition", Frontiers in Immunology, vol. 9, Oct. 16, 2018 (Oct. 16, 2018), pp. 1-15.

Xu, Zhiqiang et al: "Antibody therapies for the treatment of COVID-19", Antibody Therapeutics, vol. 3, No. 2, Apr. 30, 2020 (Apr. 30, 2020), pp. 101-108.

Invitation to Pay Additional Fees, Partial Search Report, Provisional Opinion dated Feb. 18, 2022 issued in International Application No. PCT/US2021/058057, 22 pages.

* cited by examiner

*Primary Examiner* — Gregory S Emch
*Assistant Examiner* — Ashley H. Gao
(74) *Attorney, Agent, or Firm* — Fox Rothschild LLP

(57) ABSTRACT

This disclosure provides novel broadly neutralizing anti-SARS-CoV-2 antibodies or antigen-binding fragments thereof. The disclosed anti-SARS-CoV-2 antibodies constitute a novel therapeutic strategy in protection against SARS-CoV-2 infections.

33 Claims, 20 Drawing Sheets

Specification includes a Sequence Listing.

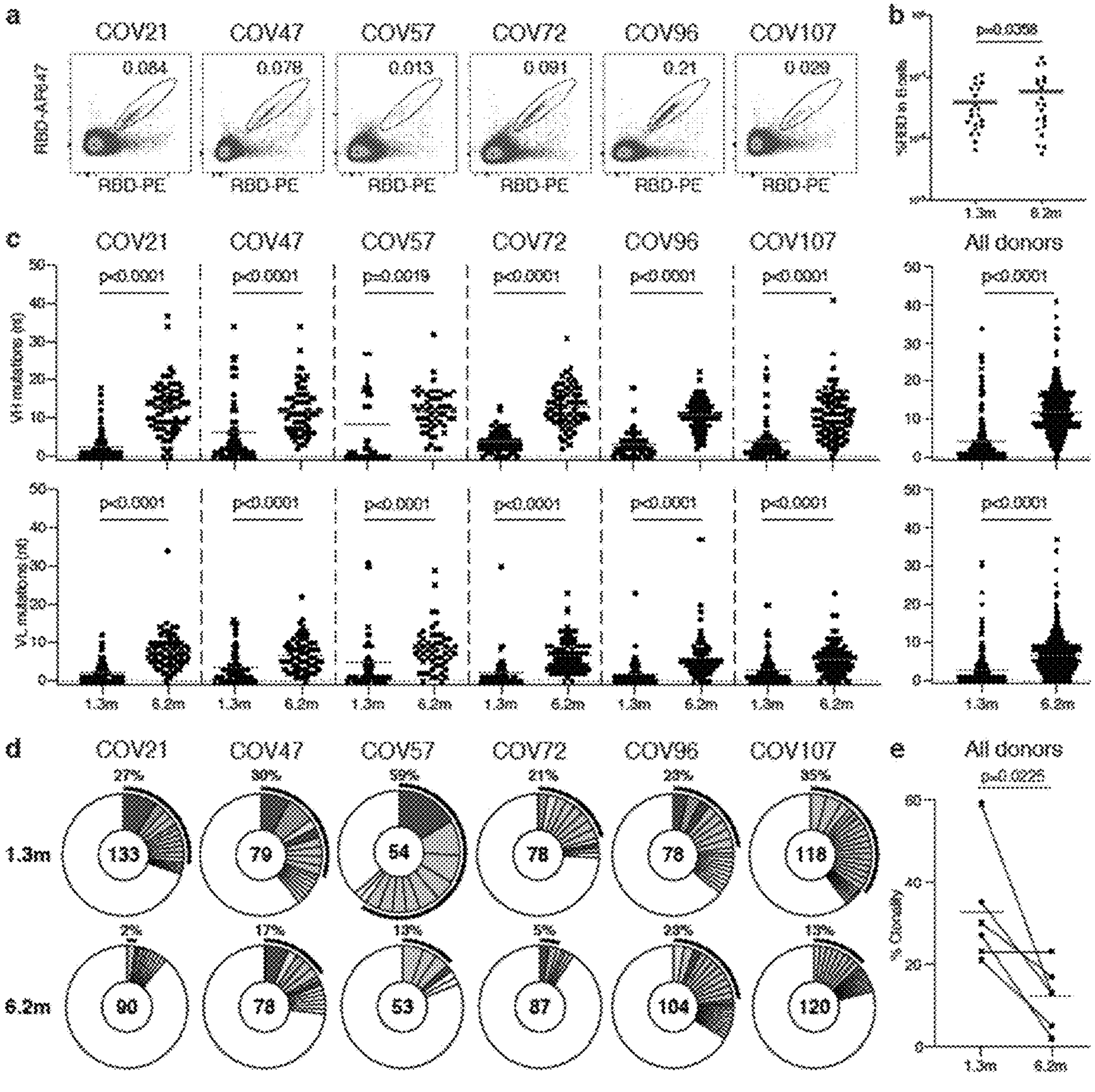
Figs. 2a, 2b, 2c, 2d, and 2e

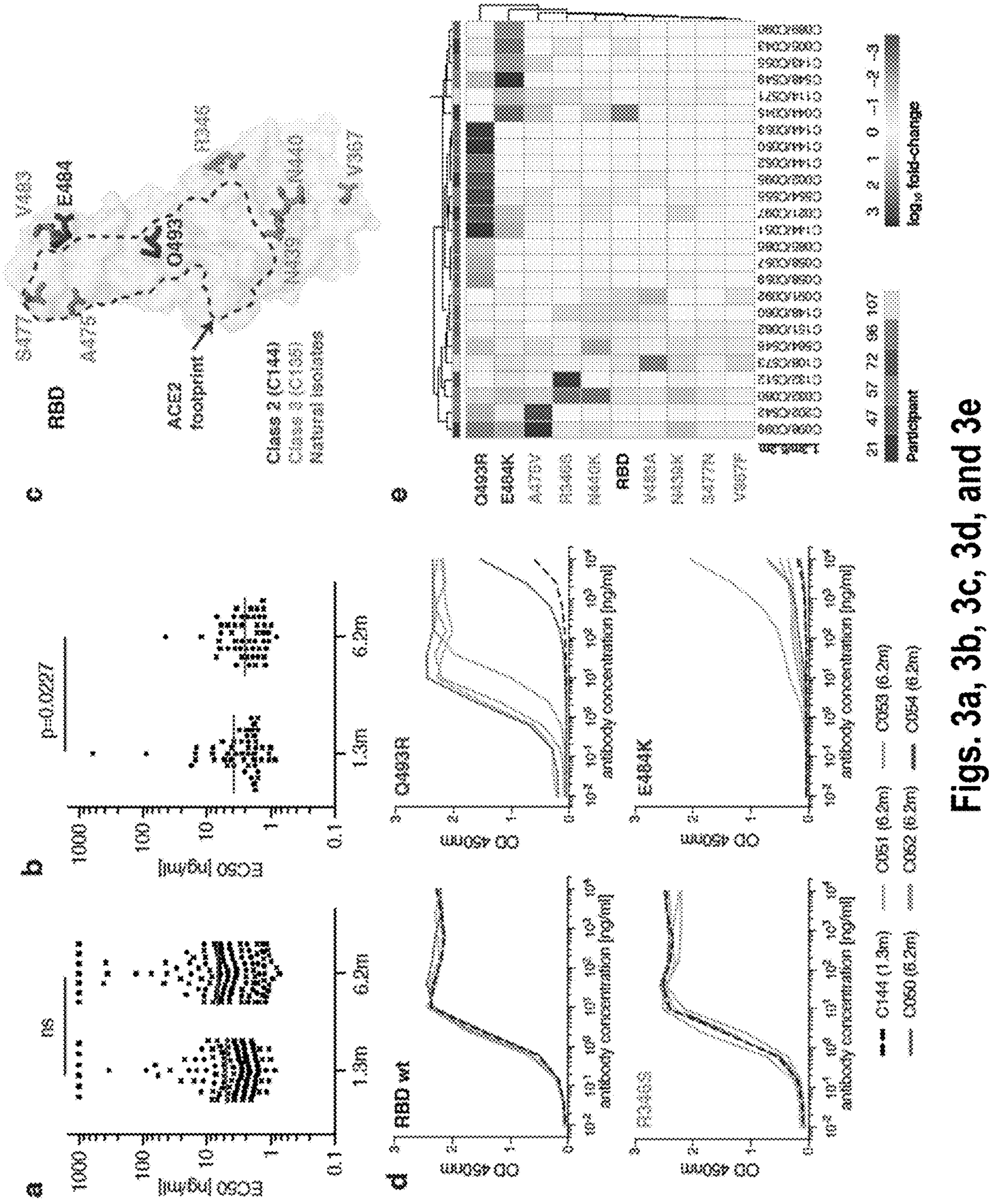
Figs. 3a, 3b, 3c, 3d, and 3e a
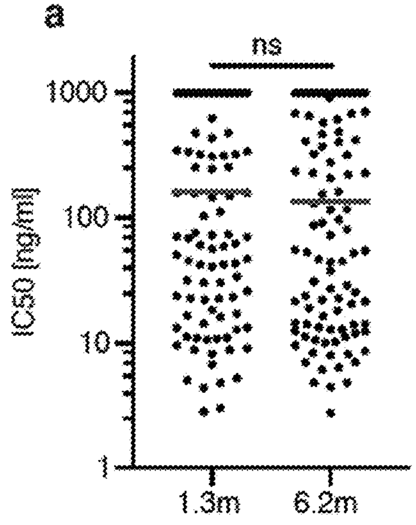
b
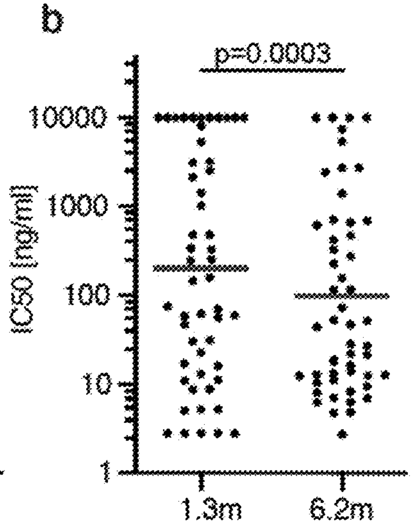
d
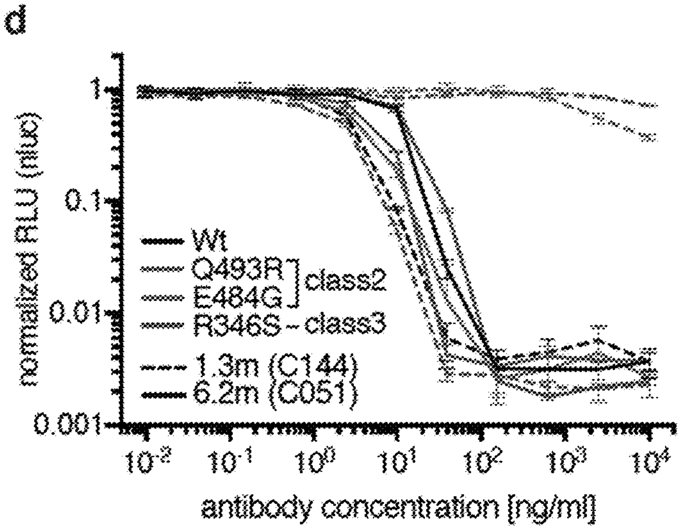
c
| | IC50 [ng/ml] | | | |
|---|---|---|---|---|
| | wt | Q493R | E484G | R346S |
| C144 | 2.73 | **>10000** | **4114.07** | 1.78 |
| C051 | 11.99 | **4.68** | **3.10** | 13.56 |
| C548 | 19.13 | **>10000** | **1591.77** | 10.84 |
| C549 | 10.95 | **2.35** | **2.29** | 8.33 |
| C032 | 100.69 | 62.42 | 45.68 | **>10000** |
| C080 | 21.52 | 21.25 | 6.00 | **5.31** |
| C132 | 1024.35 | 796.48 | 1406.57 | **>10000** |
| C512 | 21.55 | 20.78 | 12.17 | **4022.02** |
| C164 | 87.89 | 139.53 | 369.18 | 57.24 |
| C143 | 191.23 | 1576.12 | 4402.39 | 224.99 |
| C055 | 4.98 | 6.52 | 44.78 | 4.03 |
e
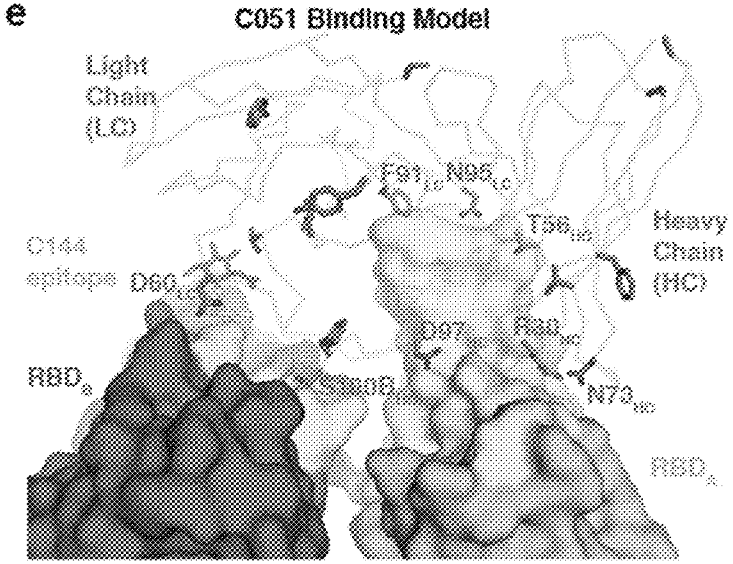
Figs. 4a, 4b, 4c, 4d, and 4e

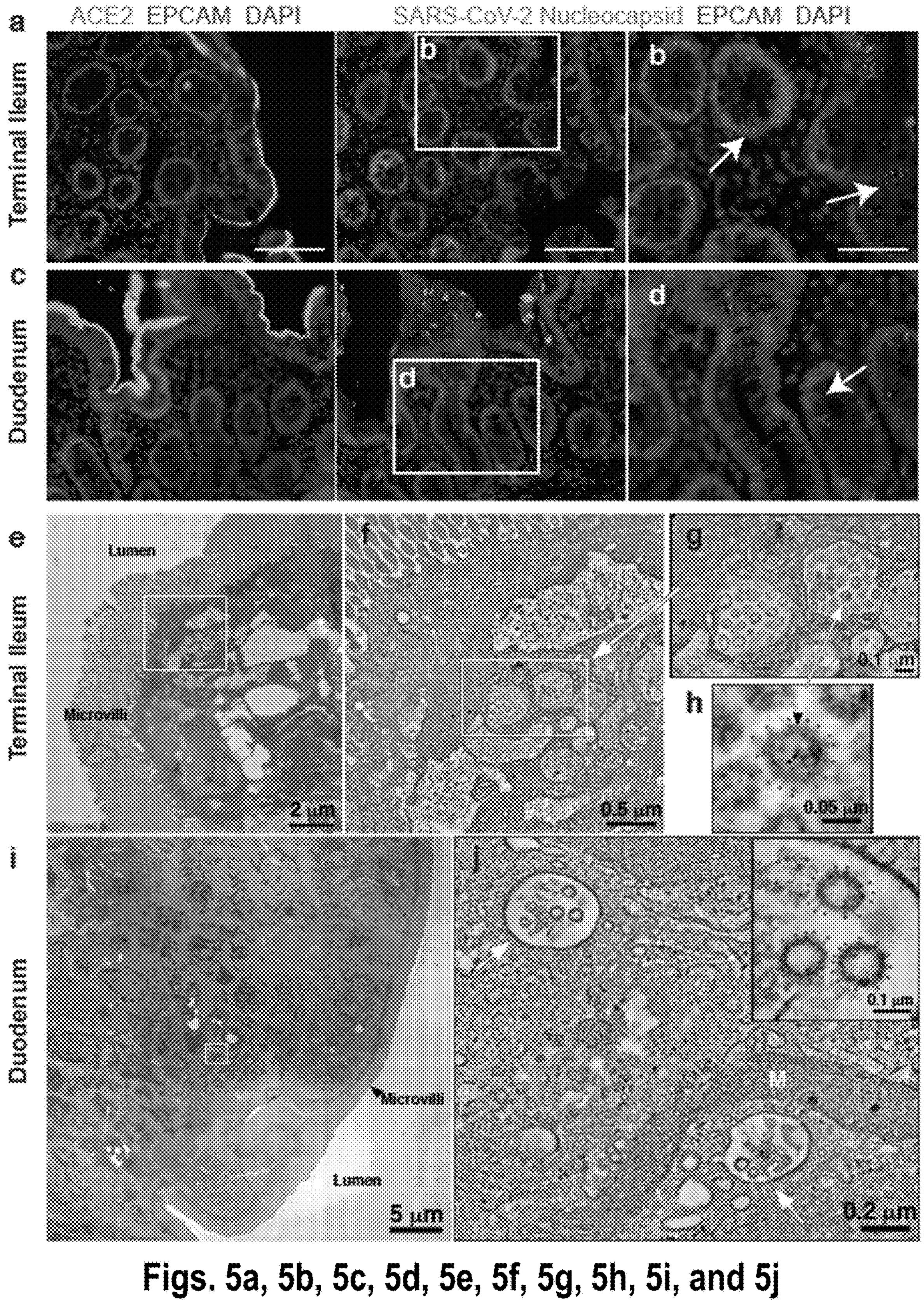
Figs. 5a, 5b, 5c, 5d, 5e, 5f, 5g, 5h, 5i, and 5j

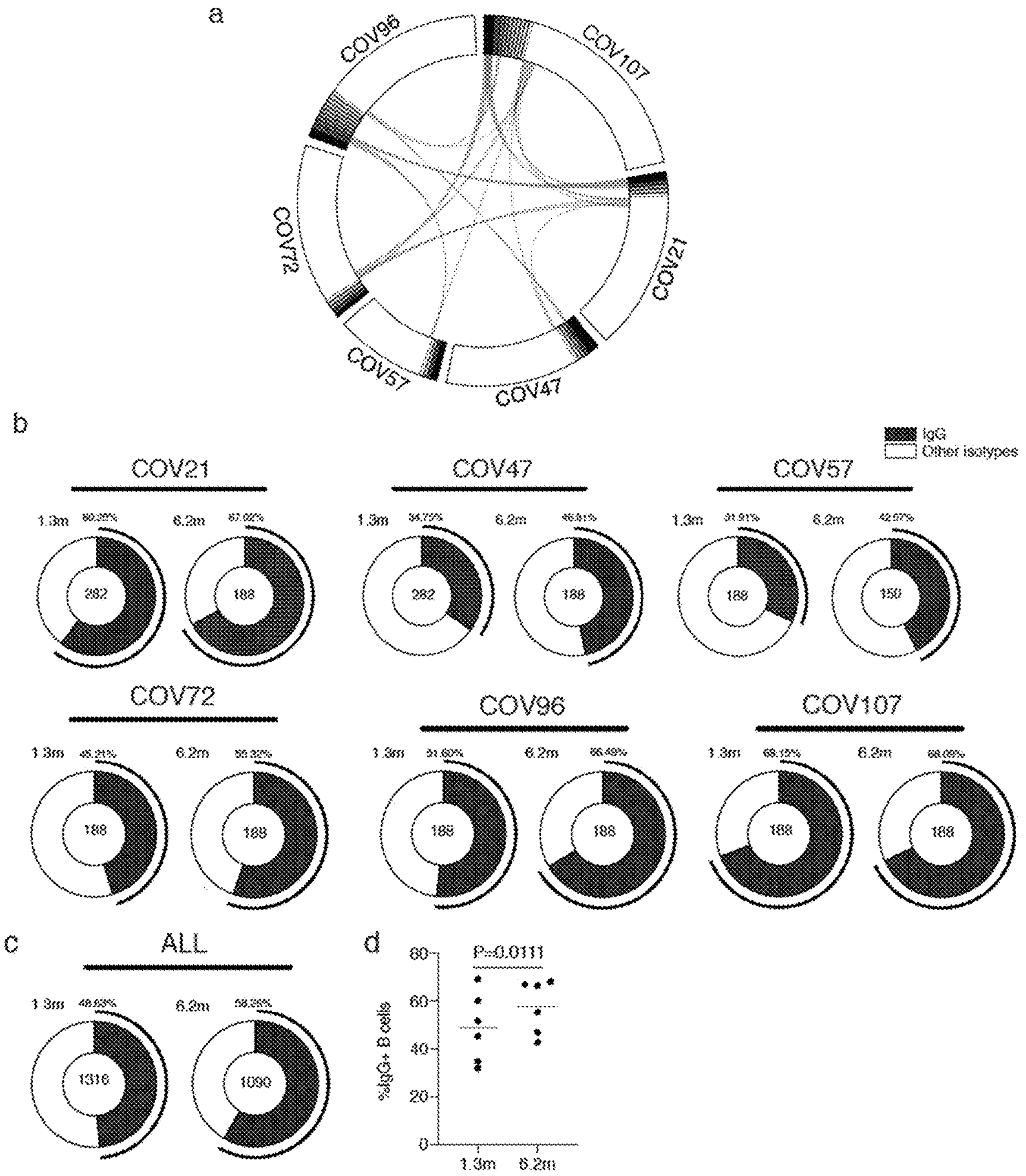
Figs. 8a, 8b, 8c, and 8d

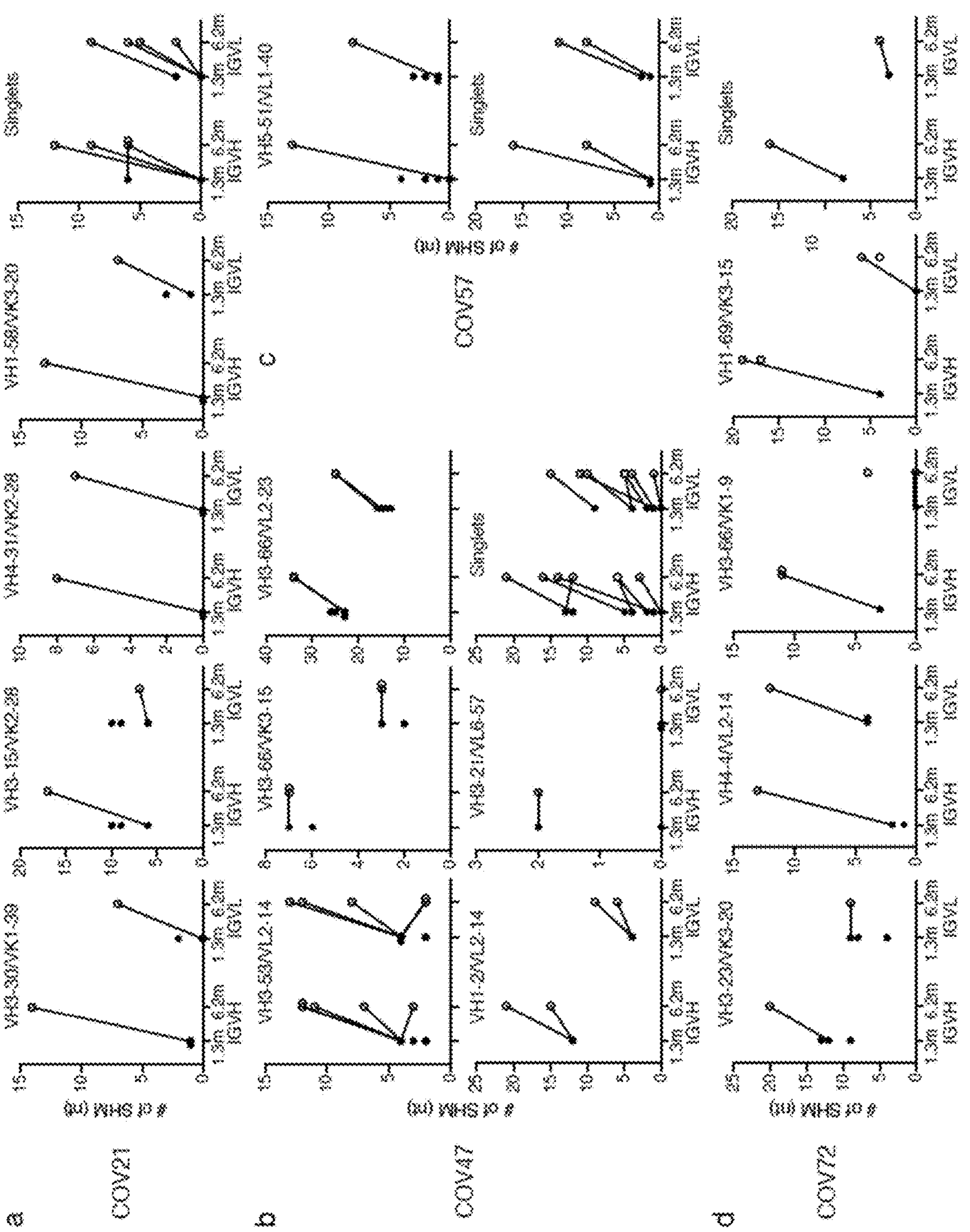
Figs. 9a, 9b, 9c, and 9d

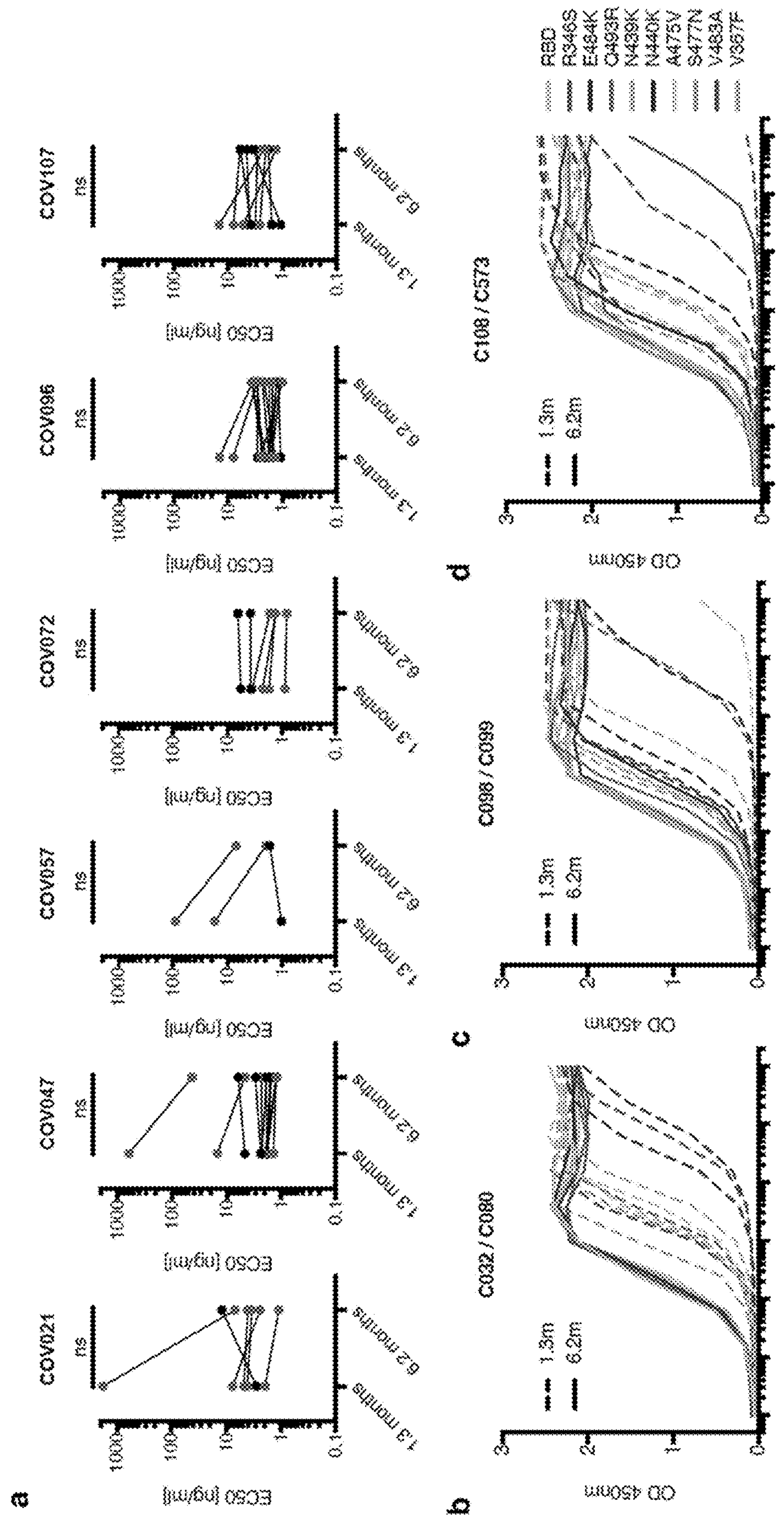
Figs. 11a, 11b, 11c, and 11d

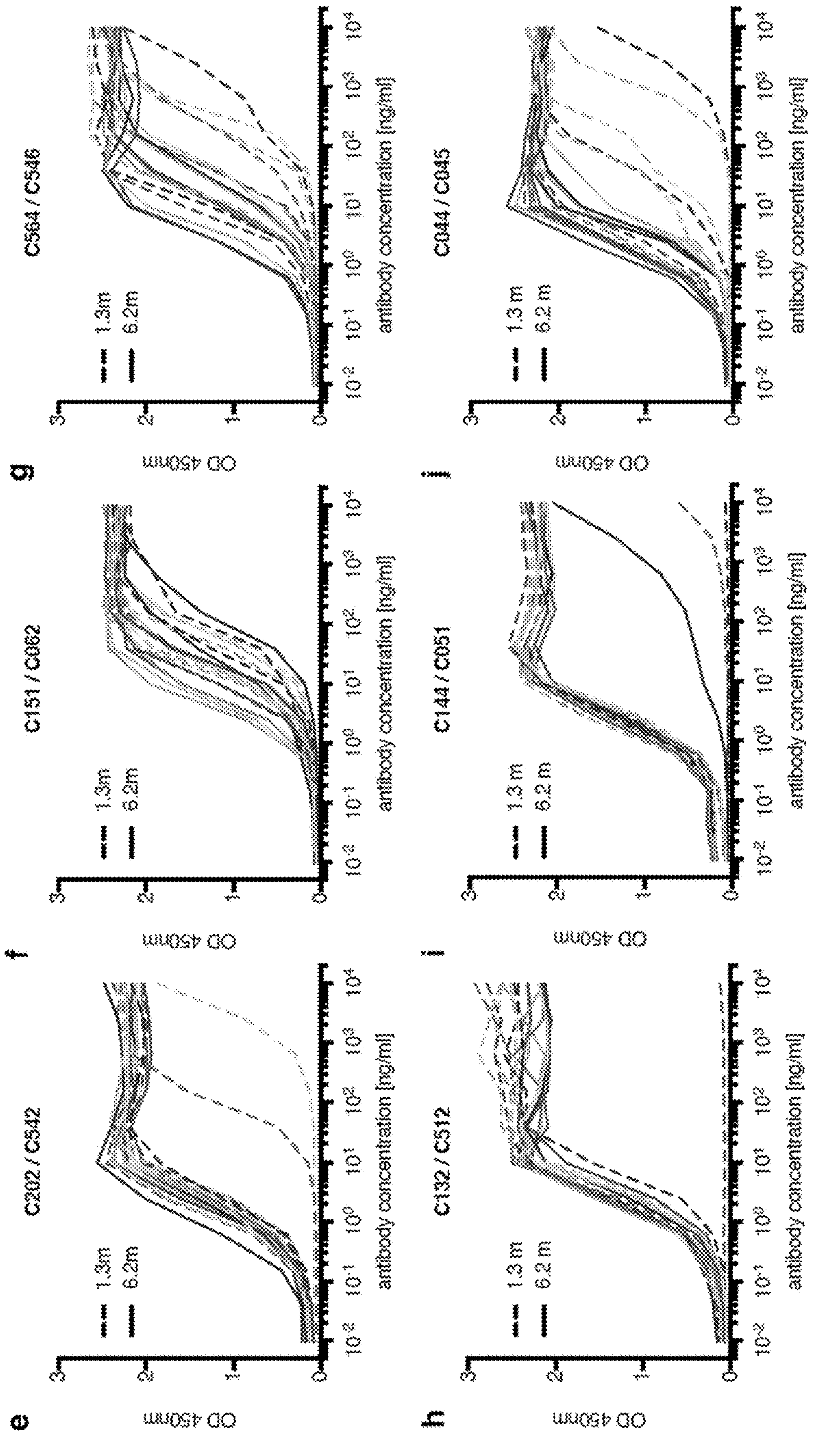
Figs. 11e, 11f, 11g, 11h, 11i, and 11j

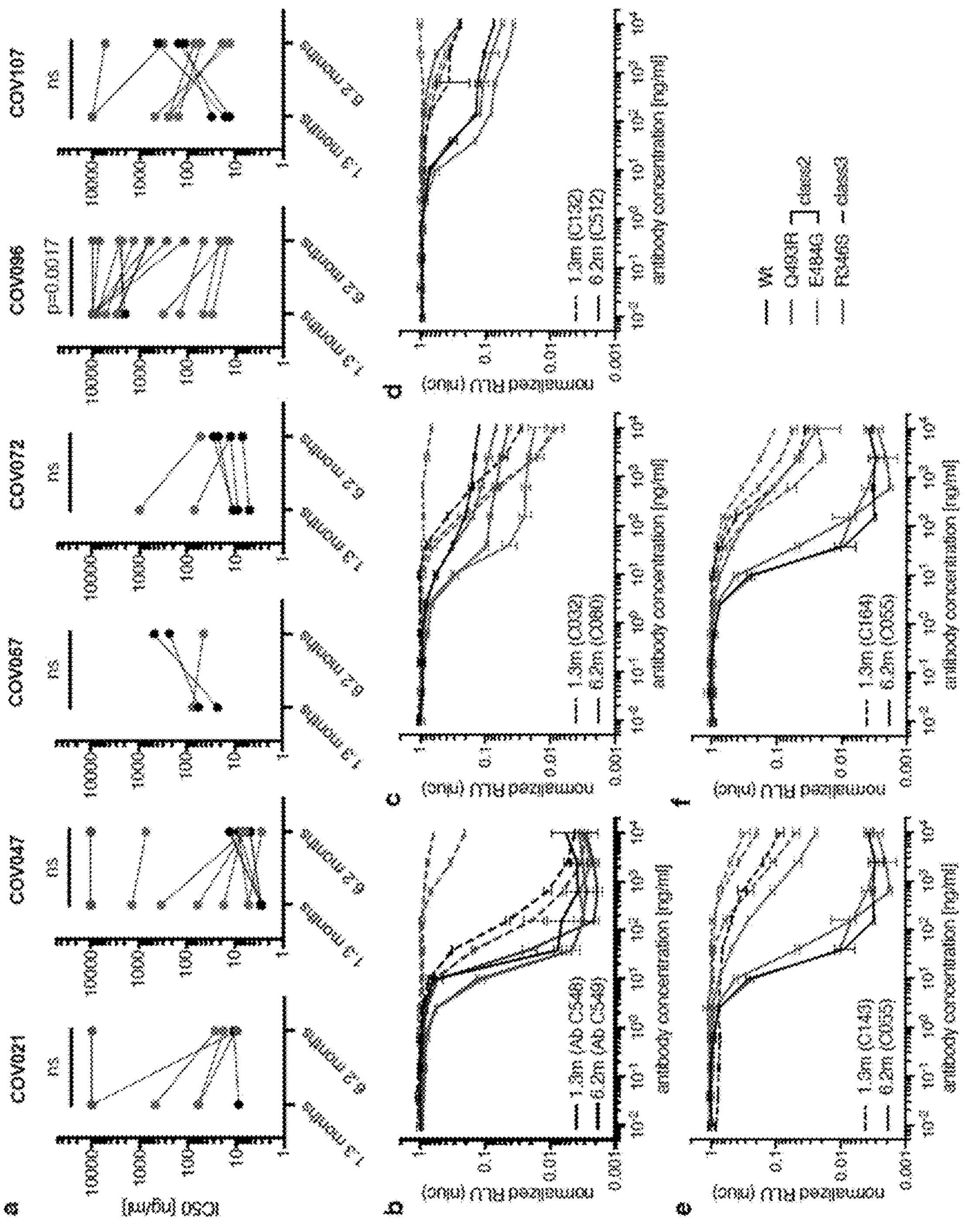
Figs. 12a, 12b, 12c, 12d, 12e, and 12f

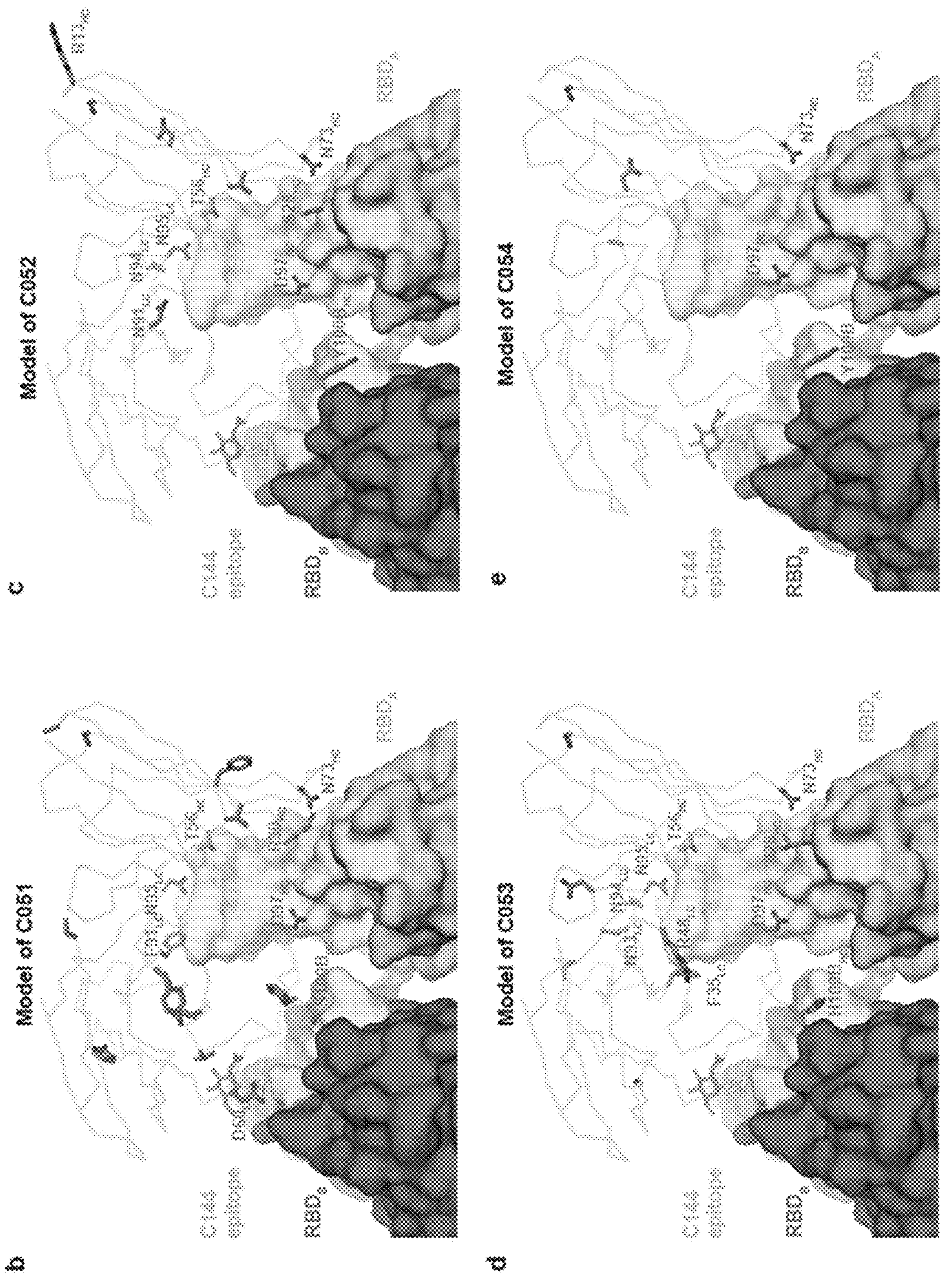
Figs. 13b, 13c, 13d, and 13e

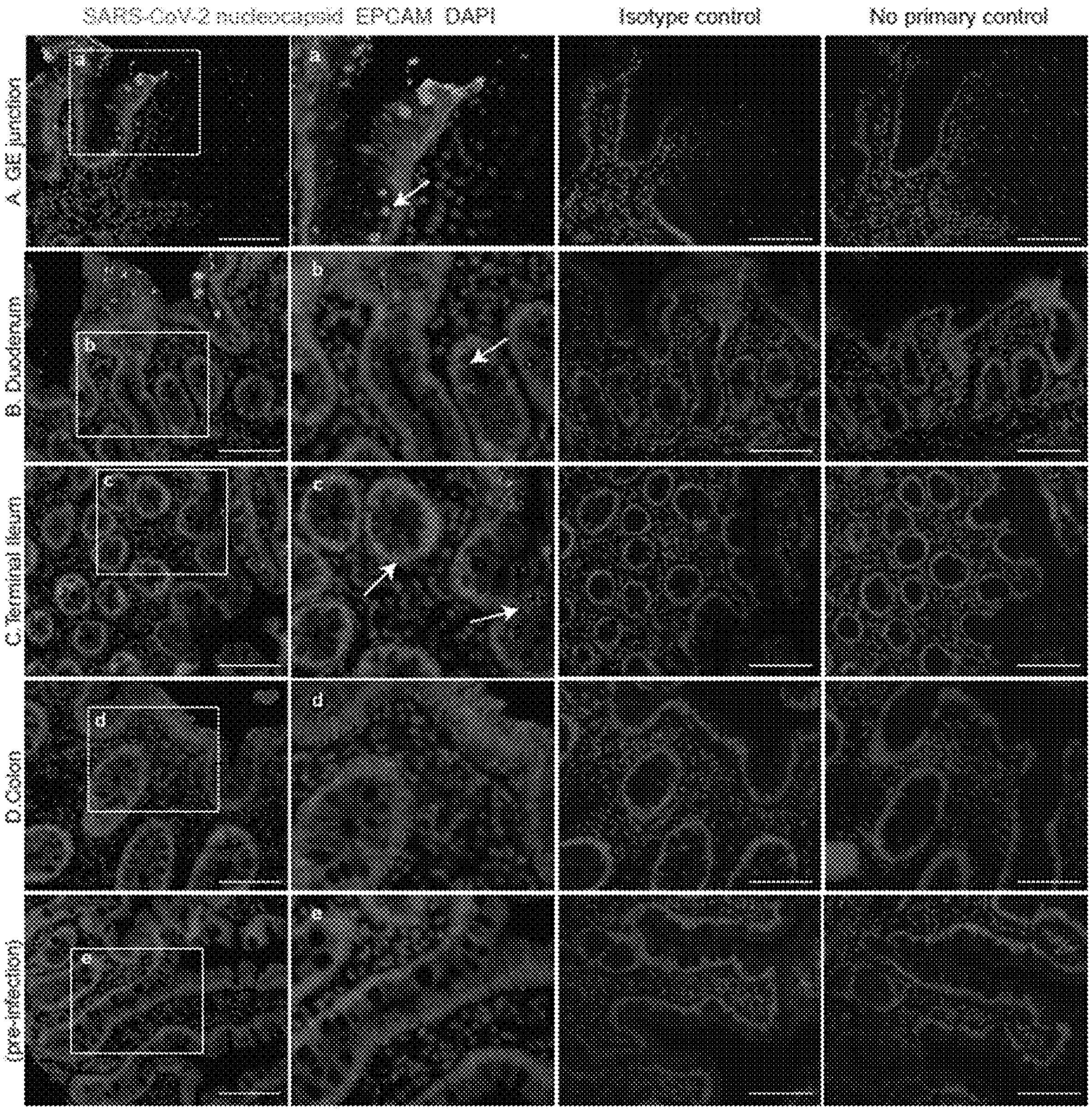
Figs. 14a, 14b, 14c, 14d, and 14e

NEUTRALIZING ANTI-SARS-COV-2 ANTIBODIES

CROSS-REFERENCE TO RELATED APPLICATIONS

This application claims priority under 35 U.S.C. § 119(e) to U.S. Provisional Patent Application No. 63/109,567, filed Nov. 4, 2020. The foregoing application is incorporated by reference herein in its entirety.

STATEMENT REGARDING FEDERALLY FUNDED RESEARCH

This invention was made with government support under Grant Nos. P01-AI138398-S1 and 2U19AI111825 awarded by the National Institutes of Health. The government has certain rights in the invention.

REFERENCE TO A SEQUENCE LISTING

The instant application contains a Sequence Listing which has been submitted electronically in ASCII format and is hereby incorporated by reference in its entirety. Said ASCII copy, created on Nov. 2, 2021, is named 070413_20654_SL.txt and is 3,393,729 bytes in size.

FIELD OF THE INVENTION

The present invention relates to antibodies directed to epitopes of SARS-CoV-2 Coronavirus 2 ("SARS-CoV-2"). The present invention further relates to the preparation and use of broadly neutralizing antibodies directed to the SARS-CoV-2 spike (S) glycoproteins for the prevention and treatment of SARS-CoV-2 infection.

BACKGROUND

SARS-CoV-2 is the virus that causes coronavirus disease 2019 (COVID-19). It contains four structural proteins, including spike (S), envelope (E), membrane (M), and nucleocapsid (N) proteins. Among them, S protein plays the most important role in viral attachment, fusion, and entry, and it serves as a target for development of antibodies, entry inhibitors, and vaccines. The S protein mediates viral entry into host cells by first binding to a host receptor through the receptor-binding domain (RBD) in the 51 subunit and then fusing the viral and host membranes through the S2 subunit. SARS-CoV and MERS-CoV RBDs recognize different receptors. SARS-CoV recognizes angiotensin-converting enzyme 2 (ACE2) as its receptor, whereas MERS-CoV recognizes dipeptidyl peptidase 4 (DPP4) as its receptor. Similar to SARS-CoV, SARS-CoV-2 also recognizes ACE2 as its host receptor binding to viral S protein. SARS-CoV-2 has infected 45 million individuals and is responsible for over 1 million deaths to date. There is a need for agents for treating or preventing SARS-CoV-2 infection.

SUMMARY

This disclosure addresses the need mentioned above in a number of aspects by providing broadly neutralizing anti-SARS-CoV-2 antibodies or antigen-binding fragments thereof.

In one aspect, this disclosure provides an isolated anti-SARS-CoV-2 antibody or antigen-binding fragment thereof that binds specifically to a SARS-CoV-2 antigen. In some embodiments, the SARS-CoV-2 antigen comprises a Spike (S) polypeptide, such as a S polypeptide of a human or an animal SARS-CoV-2. In some embodiments, the SARS-CoV-2 antigen comprises the receptor-binding domain (RBD) of the S polypeptide. In some embodiments, the RBD comprises amino acids 319-541 of the S polypeptide.

In some embodiments, the antibody or antigen-binding fragment thereof is capable of neutralizing a plurality of SARS-CoV-2 strains.

In some embodiments, the antibody or antigen-binding fragment thereof comprises: (i) a heavy chain variable region having an amino acid sequence with at least 75% identity to one selected from those in Table 4A and Table 9 below; or (ii) a light chain variable region having an amino acid sequence with at least 75% identity to one selected from those in Table 4A and Table 9 below.

In some embodiments, the antibody or antigen-binding fragment thereof comprises: (i) a heavy chain variable region having an amino acid sequence with at least 75% identity to one selected from those in Table 4A and Table 9 below; and (ii) a light chain variable region having an amino acid sequence with at least 75% identity to one selected from those in Table 4A and Table 9 below.

In some embodiments, the antibody or antigen-binding fragment thereof comprises: (i) a heavy chain variable region having the amino acid sequence of one selected from those in Table 4A and Table 9 below; or (ii) a light chain variable region having the amino acid sequence of one selected from those in Table 4A and Table 9 below.

In some embodiments, the antibody or antigen-binding fragment thereof comprises: (i) a heavy chain variable region having the amino acid sequence of one selected from those in Table 4A and Table 9 below; and (ii) a light chain variable region having the amino acid sequence of one selected from those in Table 4A and Table 9 below.

In some embodiments, the antibody or antigen-binding fragment thereof comprises a heavy chain variable region and a light chain variable region that comprises the respective amino acid sequences of a sequence pair selected from those in Table 4A and Table 9 below.

In some embodiments, the antibody or antigen-binding fragment thereof comprises: three heavy chain complementarity determining regions (HCDRs) (HCDR1, HCDR2, and HCDR3) of a heavy chain variable region having an amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, or 321; and three light chain CDRs (LCDR1, LCDR2, and LCDR3) of a light chain variable region having the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, or 322.

In some embodiments, the antibody or antigen-binding fragment thereof comprises: HCDR1, HCDR2, HCDR3, LCDR1, LCDR2, and LCDR3 comprising respective amino acid sequences of (a) SEQ ID NOs: 4600, 4601, 4602, 4603, 4604, and 4605; (b) SEQ ID NOs: 4606, 4607, 4608, 4609, 4610, and 4611; (c) SEQ ID Nos: 4612, 4613, 4614, 4615, 4616, and 4617; (d) SEQ ID NOs: 4618, 4619, 4620, 4621, 4622, and 4623; (e) SEQ ID NOs: 4624, 4625, 4626, 4627, 4628, and 4629; (f) SEQ ID NOs: 4630, 4631, 4632, 4633, 4634, and 4635; (g) SEQ ID NOs: 4636, 4637, 4638, 4639, 4640, and 4641; (h) SEQ ID NOs: 4642, 4643, 4644, 4645, 4646, and 4647; (i) SEQ ID NOs: 4648, 4649, 4650, 4651, 4652, and 4653; (j) SEQ ID NOs: 4654, 4655, 4656, 4657, 4658, and 4659; or (k) SEQ ID NOs: 4660, 4661, 4662, 4663, 4664, and 4665.

In some embodiments, The antibody or antigen-binding fragment thereof comprises: (i) a heavy chain variable region having an amino acid sequence with at least 75% identity to the amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, or 321; or having the amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, or 321; and (ii) a light chain variable region having an amino acid sequence with at least 75% identity to the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, or 322; or having the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, or 322.

In some embodiments, the antibody or antigen-binding fragment thereof comprises a heavy chain variable region and a light chain variable region that comprise the respective amino acid sequences of SEQ ID NOs: 1-2, 3-4, 5-6, 7-8, 9-10, 11-12, 13-14, 15-16, 17-18, 19-20, 21-22, 23-24, 25-26, 27-28, 29-30, 31-32, 33-34, 35-36, 37-38, 39-40, 41-42, 43-44, 45-46, 47-48, 49-50, 51-52, 53-54, 55-56, 57-58, 59-60, 61-62, 63-64, 65-66, 67-68, 69-70, 71-72, 73-74, 75-76, 77-78, 79-80, 81-82, 83-84, 85-86, 87-88, 89-90, 91-92, 93-94, 95-96, 97-98, 99-100, 101-102, 103-104, 105-106, 107-108, 109-110, 111-112, 113-114, 115-116, 117-118, 119-120, 121-122, 123-124, 125-126, 127-128, 129-130, 131-132, 133-134, 135-136, 137-138, 139-140, 141-142, 143-144, 145-146, 147-148, 149-150, 151-152, 153-154, 155-156, 157-158, 159-160, 161-162, 163-164, 165-166, 167-168, 169-170, 171-172, 173-174, 175-176, 177-178, 179-180, 181-182, 183-184, 185-186, 187-188, 189-190, 191-192, 193-194, 195-196, 197-198, 199-200, 201-202, 203-204, 205-206, 207-208, 209-210, 211-212, 213-214, 215-216, 217-218, 219-220, 221-222, 223-224, 225-226, 227-228, 229-230, 231-232, 233-234, 235-236, 237-238, 239-240, 241-242, 243-244, 245-246, 247-248, 249-250, 251-252, 253-254, 255-256, 257-258, 259-260, 261-262, 263-264, 265-266, 267-268, 269-270, 271-272, 273-274, 275-276, 277-278, 279-280, 281-282, 283-284, 285-286, 287-288, 289-290, 291-292, 293-294, 295-296, 297-298, 299-300, 301-302, 303-304, 305-306, 307-308, 309-310, 311-312, 313-314, 315-316, 317-318, 319-320, or 321-322.

In some embodiments, the antibody or antigen-binding fragment thereof comprises a heavy chain variable region and a light chain variable region that comprise the respective amino acid sequences of SEQ ID NOs: 3-4, 11-12, 141-142, 143-144, 189-190, 311-312, 313-314, 315-316, 317-318, 319-320, or 321-322.

In some embodiments, the antibody or antigen-binding fragment thereof is a multivalent antibody that comprises (a) a first target binding site that specifically binds to an epitope within the S polypeptide, and (b) a second target binding site that binds to a different epitope on the S polypeptide or a different molecule. In some embodiments, the multivalent antibody is a bivalent or bispecific antibody.

In some embodiments, the antibody or the antigen-binding fragment thereof further comprises a variant Fc constant region. In some embodiments, the antibody is a monoclonal antibody. In some embodiments, the antibody is a chimeric antibody, a humanized antibody, or a humanized monoclonal antibody. In some embodiments, the antibody is a single-chain antibody, Fab or Fab2 fragment.

In some embodiments, the antibody or antigen-binding fragment thereof is detectably labeled or conjugated to a toxin, a therapeutic agent, a polymer, a receptor, an enzyme or a receptor ligand. In some embodiments, the polymer is polyethylene glycol (PEG).

For example, an antibody of the invention may be coupled to a toxin. Such antibodies may be used to treat animals, including humans, that are infected with the virus that is etiologically linked to SARS-CoV-2. For example, an antibody that binds to the spike protein of the coronavirus that is etiologically linked to SARS-CoV-2 may be coupled to a tetanus toxin and administered to an animal suffering from infection by the aforementioned virus. The toxin-coupled antibody is thought to bind to a portion of a spike protein presented on an infected cell, and then kill the infected cell.

An antibody of the invention may be coupled to a detectable tag. Such antibodies may be used within diagnostic assays to determine if an animal, such as a human, is infected with SARS-CoV-2. Examples of detectable tags include fluorescent proteins (i.e., green fluorescent protein, red fluorescent protein, yellow fluorescent protein), fluorescent markers (i.e., fluorescein isothiocyanate, rhodamine, texas red), radiolabels (i.e., 3H, 32P, 125I), enzymes (i.e., β-galactosidase, horseradish peroxidase, β-glucuronidase, alkaline phosphatase), or an affinity tag (i.e., avidin, biotin, streptavidin).

In another aspect, this disclosure provides a pharmaceutical composition comprising: the antibody or antigen-binding fragment thereof of any one of the preceding claims and optionally a pharmaceutically acceptable carrier or excipient.

In some embodiments, the pharmaceutical comprises two or more of the antibody or antigen-binding fragment thereof described above, such as any combinations of the antibody or antigen-binding fragment thereof comprising a heavy chain and a light chain that comprise the respective amino acid sequences of one selected from those in Table 4A and Table 9.

In some embodiments, the two or more of the antibody or antigen-binding fragment thereof comprise: (1) a first antibody set comprising: (i) a first antibody or antigen-binding fragment thereof comprising a heavy chain variable region and a light chain variable region comprising the respective amino acid sequences of a first antibody selected from those in Table 4A and Table 9; and (ii) a second antibody or antigen-binding fragment thereof comprising a heavy chain variable region and a light chain variable region comprising the respective amino acid sequences of a second antibody selected from those in Table 4; or (2) a second antibody set comprising: (a) a third antibody or antigen-binding fragment thereof comprising a heavy chain variable region and a light chain variable region comprising the respective amino acid sequences of antibody selected from those in Table 4A and Table 9; and (b) a fourth antibody or antigen-binding fragment thereof comprising a heavy chain variable region and a light chain variable region comprising the respective amino acid sequences of an antibody selected from those in Table 4A and Table 9, wherein the third antibody different from the fourth antibody.

In some embodiments, the pharmaceutical composition further comprises a second therapeutic agent. In some embodiments, the second therapeutic agent comprises an anti-inflammatory drug or an antiviral compound. In some embodiments, the antiviral compound comprises: a nucleoside analog, a peptoid, an oligopeptide, a polypeptide, a protease inhibitor, a 3C-like protease inhibitor, a papain-like protease inhibitor, or an inhibitor of an RNA dependent RNA polymerase. In some embodiments, the antiviral compound may include: acyclovir, gancyclovir, vidarabine, foscarnet, cidofovir, amantadine, ribavirin, trifluorothymidine, zidovudine, didanosine, zalcitabine, or an interferon. In some embodiments, the interferon is an interferon-α or an interferon-β.

Also within the scope of this disclosure is use of the pharmaceutical composition, as described above, in the preparation of a medicament for the diagnosis, prophylaxis, treatment, or combination thereof of a condition resulting from a SARS-CoV-2.

In another aspect, this disclosure also provides (i) a nucleic acid molecule encoding a polypeptide chain of the antibody or antigen-binding fragment thereof described above; (ii) a vector comprising the nucleic acid molecule as described; and (iii) a cultured host cell comprising the vector as described. Also provided is a method for producing a polypeptide, comprising: (a) obtaining the cultured host cell as described; (b) culturing the cultured host cell in a medium under conditions permitting expression of a polypeptide encoded by the vector and assembling of an antibody or fragment thereof and (c) purifying the antibody or fragment from the cultured cell or the medium of the cell.

In another aspect, this disclosure provides a kit comprising a pharmaceutically acceptable dose unit of the antibody or antigen-binding fragment thereof of or the pharmaceutical composition as described above. Also within the scope of this disclosure is a kit for the diagnosis, prognosis, or monitoring the treatment of SARS-CoV-2 in a subject, comprising: the antibody or antigen-binding fragment thereof as described; and a least one detection reagent that binds specifically to the antibody or antigen-binding fragment thereof.

In yet another aspect, this disclosure further provides a method of neutralizing SARS-CoV-2 in a subject, comprising administering to a subject in need thereof a therapeutically effective amount of the antibody or antigen-binding fragment thereof or a therapeutically effective amount of the pharmaceutical composition, as described above.

In yet another aspect, this disclosure additionally provides a method of preventing or treating a SARS-CoV-2 infection. The method comprises administering to a subject in need thereof a therapeutically effective amount of the antibody or antigen-binding fragment thereof or a therapeutically effective amount of the pharmaceutical composition, as described above.

In some embodiments, the method of neutralizing SARS-CoV-2 in a subject comprises administering to a subject in need thereof a therapeutically effective amount of a first antibody or antigen-binding fragment thereof and a second antibody or antigen-binding fragment thereof of the antibody or antigen-binding fragment, as described above, wherein the first antibody or antigen-binding fragment thereof and the second antibody or antigen binding fragment thereof exhibit synergistic activity or a therapeutically effective amount of the pharmaceutical composition described above.

In some embodiments, the method of preventing or treating a SARS-CoV-2 infection, comprising administering to a subject in need thereof a therapeutically effective amount of a first antibody or antigen-binding fragment thereof and a second antibody or antigen-binding fragment thereof of the antibody or antigen-binding fragment, as described above, wherein the first antibody or antigen-binding fragment thereof and the second antibody or antigen binding fragment thereof exhibit synergistic activity or a therapeutically effective amount of the pharmaceutical composition described above. In some embodiments, the first antibody or antigen-binding fragment thereof is administered before, after, or concurrently with the second antibody or antigen-binding fragment thereof.

In some embodiments, the first antibody or antigen-binding fragment thereof and the second antibody or antigen-binding fragment thereof can be any combinations of the antibody or antigen-binding fragment thereof comprising a heavy chain and a light chain that comprise the respective amino acid sequences of an antibody selected from those in Table 4A and Table 9.

In some embodiments, the second therapeutic agent comprises an anti-inflammatory drug or an antiviral compound. In some embodiments, the antiviral compound comprises a nucleoside analog, a peptoid, an oligopeptide, a polypeptide, a protease inhibitor, a 3C-like protease inhibitor, a papain-like protease inhibitor, or an inhibitor of an RNA dependent RNA polymerase. In some embodiments, the antiviral compound may include: acyclovir, gancyclovir, vidarabine, foscarnet, cidofovir, amantadine, ribavirin, trifluorothymidine, zidovudine, didanosine, zalcitabine, or an interferon. In some embodiments, the interferon is an interferon-α or an interferon-β.

In some embodiments, the antibody or antigen-binding fragment thereof is administered before, after, or concurrently with the second therapeutic agent or therapy. In some embodiments, the antibody or antigen-binding fragment thereof is administered to the subject intravenously, subcutaneously, or intraperitoneally. In some embodiments, the antibody or antigen-binding fragment thereof is administered prophylactically or therapeutically.

In another aspect, this disclosure further provides a method for detecting the presence of SARS CoV-2 in a sample comprising the steps of: (i) contacting a sample with the antibody or antigen-binding fragment thereof described above; and (ii) determining binding of the antibody or antigen-binding fragment to one or more SARS CoV-2 antigens, wherein binding of the antibody to the one or more SARS CoV-2 antigens is indicative of the presence of SARS CoV-2 in the sample. In some embodiments, the sample is a blood sample.

In some embodiments, the SARS-CoV-2 antigen comprises a S polypeptide, such as a S polypeptide of a human or an animal SARS-CoV-2. In some embodiments, the SARS-CoV-2 antigen comprises the receptor-binding domain (RBD) of the S polypeptide. In some embodiments, the RBD comprises amino acids 319-541 of the S polypeptide.

In some embodiments, the antibody or antigen-binding fragment thereof is conjugated to a label. In some embodiments, the step of detecting comprises contacting a secondary antibody with the antibody or antigen-binding fragment thereof and wherein the secondary antibody comprises a label. In some embodiments, the label includes a fluorescent label, a chemiluminescent label, a radiolabel, and an enzyme.

In some embodiments, the step of detecting comprises detecting fluorescence or chemiluminescence. In some embodiments, the step of detecting comprises a competitive binding assay or ELISA.

In some embodiments, the method further comprises binding the sample to a solid support. In some embodiments, the solid support includes microparticles, microbeads, magnetic beads, and an affinity purification column.

The foregoing summary is not intended to define every aspect of the disclosure, and additional aspects are described in other sections, such as the following detailed description. The entire document is intended to be related as a unified disclosure, and it should be understood that all combinations of features described herein are contemplated, even if the combination of features are not found together in the same sentence, or paragraph, or section of this document. Other features and advantages of the invention will become apparent from the following detailed description. It should be understood, however, that the detailed description and the specific examples, while indicating specific embodiments of the disclosure, are given by way of illustration only, because various changes and modifications within the spirit and scope of the disclosure will become apparent to those skilled in the art from this detailed description.

BRIEF DESCRIPTION OF THE DRAWINGS

FIGS. 1*a-d* show the results of serological assays measuring plasma reactivity to RBD (FIGS. 1*a*, 1*b*, and 1*c*) and N protein (FIG. 1*d*) at the initial 1.3- and 6.2-month follow-up visit, respectively. FIG. 1*a* shows the result of the anti-RBD IgM. FIG. 1*b* shows the result of the anti-RBD IgG. FIG. 1*c* shows the result of the anti-RBD IgA FIG. 1*d* shows the result of the anti-N total antibodies. The normalized area under the curve (AUC) values for 87 individuals and Cut-off Index (COI) values for 80 individuals are shown in FIGS. 1*a-c* and FIG. 1*d* for both time points, respectively. Positive and negative controls were included for validation (Robbiani, D. F. et al. Nature 584, 437-442). FIG. 1*e* shows a relative change in plasma antibody levels between 1.3 and 6.2 months for anti-RBD IgM, IgG, IgA, and anti-N total Ig, respectively. FIGS. 1*f*-I show a relative change in antibody levels between 1.3 and 6.2 months plotted against the corresponding antibody levels at 1.3 months. FIG. 1*f* shows the result of the anti-RBD IgM. r=−0.83, p<0.0001. FIG. 1*g* shows the result of the anti-RBD IgG. r=−0.76, p<0.0001. FIG. 1*h* shows the result of the anti-RBD IgA. r=−0.67, p<0.0001. FIG. 1*i* shows the result of the anti-N total antibodies. r=−0.23, p=0.039. FIG. 1*j* shows a ranked average half-maximal inhibitory plasma neutralizing titer (NT50) at 1.3 months and 6.2 months for the 87 individuals studied. FIG. 1*k* is a graph showing NT50 for plasma collected at 1.3 and 6.2 months p<0.0001. FIG. 1*l* shows a relative change in plasma neutralizing titers between 1.3 and 6.2 months plotted against the corresponding titers at 1.3 months. For FIGS. 1*a-e* and 1*k* show plotted values, and horizontal bars indicate geometric mean. Statistical significance was determined using the Wilcoxon matched-pairs signed rank test in FIGS. 1*a-d* and *k* show Friedman with Dunn's multiple comparison test in FIG. 1*e*. The r and p values in FIGS. 1*f*-I and *l* were determined by two-tailed Spearman's correlations.

FIGS. 2*a*, 2*b*, 2*c*, 2*d*, and 2*e* are a set of diagrams showing anti-SARS-CoV-2 RBD monoclonal antibodies. FIG. 2*a* shows representative flow cytometry plots showing dual AlexaFluor-647-RBD- and PE-RBD-binding B cells for six study individuals (gating strategy is in FIG. 6). Percentage of antigen-specific B cells is indicated. FIG. 2*b*, as in FIG. 2*a*, shows a graph summarizing % RBD binding memory B cells in samples obtained at 1.3 and 6.2 months from 21 randomly selected individuals. The horizontal bars indicate geometric mean values. Statistical significance was determined using Wilcoxon matched-pairs signed rank test. FIG. 2*c* shows number of somatic nucleotide mutations in the IGVH (top) and IGVL (bottom) in antibodies obtained after 1.3 or 6.2 months from the indicated individual or all donors (right). FIG. 2*d* shows pie charts depicting the distribution of antibody sequences from 6 individuals after 1.3 (upper panel) or 6.2 months (lower panel). The number in the inner circle indicates the number of sequences analyzed for the individual denoted above the circle. Pie slice size is proportional to the number of clonally related sequences. The black outline indicates the frequency of clonally expanded sequences detected in each patient. Colored slices indicate persisting clones (same IGHV and IGLV genes and highly similar CDR3s) found at both timepoints in the same patient. Grey slices indicate clones unique to the timepoint. White slices indicate singlets found at both timepoints, while the remaining white area indicates sequences isolated once. FIG. 2*e* is a graph showing relative clonality at both time points timepoints. The horizontal bars indicate mean values. Statistical significance was determined using two-tailed Mann-Whitney U-tests or paired t-test.

FIGS. 3*a*, 3*b*, 3*c*, 3*d*, and 3*e* are a set of diagrams showing anti-SARS-CoV-2 RBD antibody reactivity. FIG. 3*a* shows graphs that illustrate anti-SARS-CoV-2 RBD antibody reactivity. ELISA $EC_{50}$ values for all antibodies measured at 1.3 and 122 selected monoclonal antibodies at 6.2 months. Horizontal bars indicate the geometric mean. Statistical significance was determined using Mann-Whitney U-tests. FIG. 3*b* shows $EC_{50}$ values for all antibodies that appear at 1.3 and 6.2 months. Average of two or more experiments. Horizontal bars indicate a geometric mean. Statistical significance was determined using the Wilcoxon matched-pairs signed rank test. FIG. 3*c* shows a surface representation of the RBD with the ACE-2 binding footprint indicated as a dotted line and selected residues found in circulating strains (grey) and residues that mediate resistance to class 2 (C144) and 3 (C135) antibodies highlighted as sticks. FIG. 3*d* shows graphs depicting ELISA binding curves for C144 (black dashed line) and its clonal relatives obtained after 6.2 months (C050-54, solid lines) binding to wild type, Q493R, R346S, and E484K mutant RBDs. FIG. 3*e* is a heat map showing log 10 relative fold change in $EC_{50}$ against the indicated RBD mutants for antibody clonal pairs obtained at 1.3 and 6.2 months. The participant origin for each antibody pair is indicated above. All experiments were performed at least twice.

FIGS. 4*a*, 4*b*, 4*c*, 4*d*, and 4*e* are a set of diagrams showing anti-SARS-CoV-2 RBD antibody neutralizing activity. FIG. 4*a* shows the results of a SARS-CoV-2 pseudovirus neutralization assay. $IC_{50}$ values for all antibodies measured at 1.3 months and 122 selected antibodies at 6.2 months. Antibodies with $IC_{50}$ values above 1 µg/ml were plotted at 1 µg/ml. Mean of 2 independent experiments. The bar indicates the geometric mean. Statistical significance was determined using Mann-Whitney U-test. FIG. 4*b* shows $IC_{50}$ values for antibodies appearing at 1.3 and 6.2 months. The bar indicates the geometric mean. Statistical significance was determined using the Wilcoxon matched-pairs signed rank test. FIG. 4*c* shows $IC_{50}$ values for 5 different pairs of mAb clonal relatives obtained after 1.3 or 6.2 months for neutralization of wild type and mutant SARS-CoV-2 pseudovirus. Antibody IDs of the 1.3 months/6.2 months mAb pairs as indicated. FIG. 4*d* is a graph showing the normalized relative luminescence values for cell lysates of $293T_{ACE2}$ cells 48 hpi with SARS-CoV-2 pseudovirus harboring wt RBD or mutant RBDs in the presence of increasing concentrations of mAbs C144 (1.3 months, dashed lines) or C051 (6.2 months, solid lines). FIG. 4*e* shows a surface representation of two adjacent "down" RBDs ($RBD_A$ and $RBD_B$) on a spike trimer with the C144 epitope on the RBDs highlighted in cyan and positions of amino acid mutations that accumulated in C051 compared to the parent antibody C144 highlighted as stick side chains on a Cα atom representation C051 $V_HV_L$ binding to adjacent RBDs. The C051 interaction with two RBDs was modeled based on a cryo-EM structure of C144 Fab bound to spike trimer.

FIGS. 5*a*, 5*b*, 5*c*, 5*d*, 5*e*, 5*f*, 5*g*, 5*h*, 5*i*, and 5*j* are a set of photographs showing immunofluorescence and electron microscopy imaging of intestinal biopsies. FIG. 5*a* shows immunofluorescence images of human enterocytes stained for EPCAM, DAPI, and either ACE2 (FIG. 5*a* and FIG. 5*c*) or SARS-CoV-2 N (FIG. 5*b* and FIG. 5*d*) in intestinal biopsies taken 92 days after COVID-19 symptom onset in the terminal ileum (FIGS. 5*a-b*) or duodenum (FIGS. 5*c-d*). Arrows indicate enterocytes with detectable SARS-CoV-2 antigen. The white scale bar corresponds to 100 µm. FIGS. 5*e-h* show SARS-CoV-2 virions within terminal ileum of CGI-088 (identified as described in methods). FIG. 5*e* shows a montaged 2D overview of a region of apical epithelium. FIG. 5*f* shows a tomographic slice (1.5 nm) of a 3D reconstruction of the area of epithelial cell cytoplasm indicated by the white square in FIG. 5*e*. Two coronavirus-filled exit compartments (center) are surrounded by other membranous compartments with dissimilar contents. FIG. 5*g* shows the tomographic detail of the two exit compartments, indicated by the white rectangle in FIG. 5*f*. Each compartment contains ~20 presumptive SARS-CoV-2 virions. FIG. 5*h* shows the detail of a single virion (indicated by the white arrow in FIG. 5*g*), showing densities for the membrane bilayer (black arrowhead), punctate core structures (*), and surface spikes (dots). FIGS. 5*i-j* show SARS-CoV-2 within duodenum of CGI-088 (identified as described in methods). FIG. 5*i* shows a montaged 2D overview of a region of the duodenal apical epithelium. FIG. 5*j* shows a tomographic slice (1.5 nm) of a 3D reconstruction of the area of epithelial cell cytoplasm indicated by the white square in FIG. 5*i*. SARS-CoV-2 virions are localized to two smooth-walled exit compartments (white arrows). Inset in FIG. 5*j* shows the detail of three presumptive SARS-CoV-2 virions from the compartment in the upper left of FIG. 5*j*. Surface spikes are indicated by dots. M, Mitochondrion.

FIG. 6*a* shows the gating strategy used for cell sorting. Gating was on singlets that were CD20+ and CD3−CD8−CD16−Ova−. Sorted cells were RBD−PE+ and RBD−AF647+. FIG. 6*b* shows flow cytometry depicting the percentage of RBD-double positive memory B cells from month 1.3 or month 6 post-infection in 21 randomly selected patients.

FIG. 7*a* shows a comparison of the frequency distributions of human V genes of anti-SARS-CoV-2 antibodies from donors at 7 week to 6 months (Robbiani et al.). FIG. 7*b* shows a comparison of the frequency distributions of human V genes of anti-SARS-CoV-2 antibodies from this study to sequences previously obtained.

FIGS. 8*a*, 8*b*, 8*c*, and 8*d* show circo plots and IgG positive RBD specific B cells. FIG. 8 shows sequences from all six individuals with clonal relationships depicted as in FIG. 2*d*. Interconnecting lines indicate the relationship between antibodies that share V and J gene segment sequences at both IGH and IGL. Purple, the lines connect related clones, clones and singles, and singles to each other, respectively. FIG. 8*b* shows the number of IgG heavy chain sequences (black) analyzed from six individuals at month 1.3 (left panel) or month 6.2 post-infection (right panel) for each patient. The number in the inner circle indicates the number of cells that were sorted for each individual denoted above the circle. FIG. 8*c*, the same as FIG. 8*b*, but shows the combined data of all 6 patients. FIG. 8*d* shows a comparison of the percentage of IgG positive B cells from six individuals at month 1.3 or month 6.2 post-infection. The horizontal bars indicate the mean. Statistical significance was determined using paired t-test.

FIGS. 9*a*, 9*b*, 9*c*, 9*d*, 9*e*, and 9*f* show analysis of antibody somatic hypermutation of persisting clones. Number of somatic nucleotide mutations in both the IGVH and IGVL of persisting clones found at month 1.3 (solid circles) and month 6.2 time points (open circles) in patients (FIG. 9*a*) COV21, (FIG. 9*b*) COV47, (FIG. 9*c*) COV57, (FIG. 9*d*) COV72, (FIG. 9*e*) COV96, and (FIG. 9*f*) COV107. The VH and VL gene usage of each clonal expansion is indicated above the graphs, or are indicated as "Singlets" if the persisting sequence was isolated only once at both time points. The connecting line indicates the SHM of the clonal pairs that were expressed as a recombinant mAbs.

FIG. 10*a* shows the number of the amino acid length of the CDR3s at the IGVH and IGVL for each individual. The horizontal bars indicate the mean. The number of antibody sequences (IGVH and IGVL) evaluated for each participant are n=90 (COV21), n=78 (COV47), n=53 (COV57), n=87 (COV72), n=104 (COV96), n=120 (COV107). Right panel show all antibodies combined (n=532 for both IGVH and IGVL). FIG. 10*b* shows distribution of the hydrophobicity GRAVY scores at the IGH CDR3 in antibody sequences from this study compared to a public database (see Methods for statistical analysis). The box limits are at the lower and upper quartiles, the center line indicates the median, the whiskers are 1.5× interquartile range, and the dots represent outliers.

FIGS. 11*a*, 11*b*, 11*c*, 11*d*, 11*e*, 11*f*, 11*g*, 11*h*, 11*i*, and 11*j* show ELISA of wt/mutant RBD for mAbs. FIG. 11*a* shows EC50 values of shared singlets and shared clones of mAbs obtained at the initial 1.3 and 6.2 months follow-up visit, divided by patient. Lines connect shared singlets/clones. mAbs with improved EC50 at 6.2 months follow-up visit are highlighted; remaining mAbs are shown in black. Statistical significance was determined using the Wilcoxon matched-pairs signed rank test. FIGS. 11*b-j* are graphs showing ELISA binding curves for different antibodies obtained at 1.3 months (dashed lines) and their clonal relatives obtained after 6.2 months (solid lines) binding to wild type, R346S, E484K, Q493R, N439K, N440K, A475V, S477N, V483A and V367F RBDs (colors as indicated). Antibody IDs of pairs as indicated on top of panels (1.3 m/6.2 m).

FIGS. 12*a*, 12*b*, 12*c*, 12*d*, 12*e*, and 12*f* show neutralization of wt/mutant RBD pseudotypes by mAbs. FIG. 12*a* shows IC50 values of shared singlets and shared clones of mAbs obtained at the initial 1.3 and 6.2 months follow-up visit, divided by patient. Lines connect shared singlets/clones. mAbs with undetectable IC50 at 1.3 months are plotted at 10 μg/ml and are highlighted, mAbs with improved IC50 at 6.2 months follow-up visit are highlighted, remaining mAbs are shown in black. Statistical significance was determined using the Wilcoxon matched-pairs signed rank test. FIGS. 12*b-f* show the normalized relative luminescence values for cell lysates of 293TAce2 cells 48 hpi with SARS-CoV-2 pseudovirus harboring wt RBD or RBD-mutants in the presence of increasing concentrations of mAbs obtained at the 1.3 months initial visit (1.3 m, dashed lines) and their shared clones/singlets at the 6.2 follow-up visit (6.2 m, continuous lines). Antibody IDs as indicated.

FIGS. 13*a*, 13*b*, 13*c*, 13*d*, and 13*e* show sequence alignment and binding projection. SEQ ID NOs for the aligned sequences are provided as follows: C144 (SEQ ID NOs: 317 (VH)/318(VL)); C051 (SEQ ID NOs: 3 (VH)/4 (VL)); C052 (SEQ ID NOs: 5 (VH)/6(VL)); C053 (SEQ ID NOs: 7(VH)/8 (VL)); and C054 (SEQ ID NOs: 9 (VH)/10(VL)).

FIGS. 14*a*, 14*b*, 14*c*, 14*d*, and 14*e* are a set of diagrams showing SARS-CoV-2 antigen in human enterocytes along the gastrointestinal tract 3 months post COVID-19 Immunofluorescence (IF) images of human gut tissue are shown. Staining is for EPCAM, DAPI, and SARS-CoV-2 nucleocapsid. Samples are derived from intestinal biopsies along the gastrointestinal tract as indicated (FIGS. 14*a-e*). FIGS. 14*a-d* are biopsies from one individual taken 92 days post COVID-19 symptom onset. FIG. 14*e* is a biopsy 27 months prior to COVID symptom onset from the same individual. Arrows indicate enterocytes with detectable SARS-CoV-2 antigen. Isotype and no primary controls for each tissue are shown in the last two columns. The scale bar corresponds to 100 μm.

FIG. 15*a* shows immunofluorescence (IF) images of biopsy samples along the gastrointestinal tract in different individuals are shown. Staining is for EPCAM, DAPI, and SARS-CoV-2 nucleocapsid. Samples are derived from intestinal biopsies from 3 patients (CGI089, CGI092, COVID OSH) taken at least 3 months after COVID-19 infection. Arrows indicate enterocytes with detectable SARS-CoV-2 antigen. The scale bar corresponds to 100 μm. FIG. 15*b* shows quantification of SARS-CoV-2 positive cells by immunofluorescence (IF). The number of cells staining positive for the nucleocapsid protein (N) of SARS-CoV-2 per mm2 of intestinal epithelium is shown. FIGS. 15*a-b* show biopsy samples from the indicated individuals of the duodenum and terminal ileum, respectively. Black dots represent the number of available biopsy specimens for each individual from the respective intestinal segment. Boxes represent median values and whiskers the 95% CI.

DETAILED DESCRIPTION OF THE INVENTION

Figures 1A, 1B, 1C, 1D, 1E, 1F, 1G, 1H, 1I, 1J, 1K, 1L:
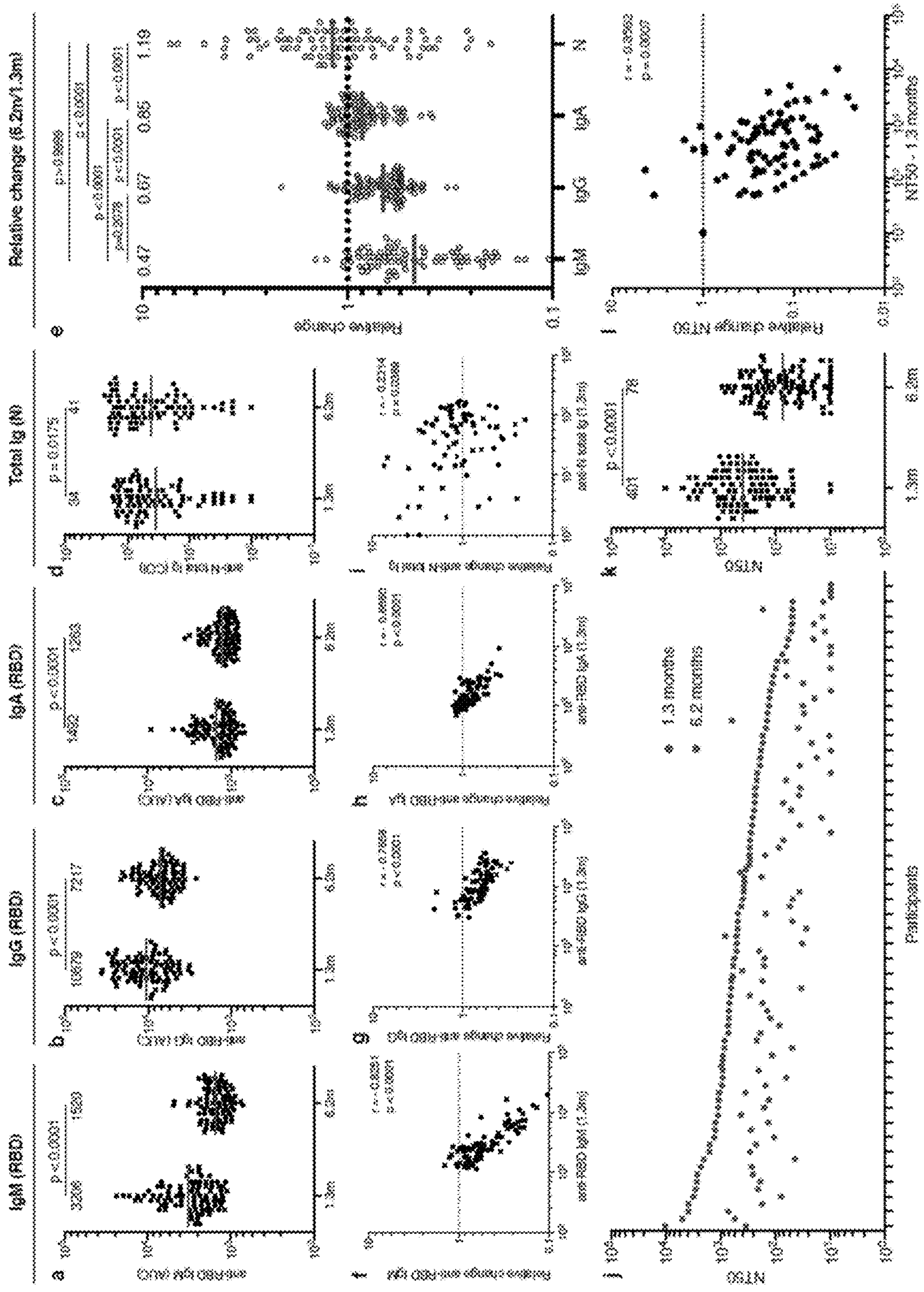
FIGS. 1*a*, 1*b*, 1*c*, 1*d*, 1*e*, 1*f*, 1*g*, 1*h*, 1*i*, 1*j*, 1*k*, and 1*l* are a set of diagrams showing plasma antibody dynamics against SARS-CoV-2.

SARS-CoV-2 represents a serious public health concern. Methods to diagnose and treat persons who are infected with SARS-CoV-2 provide the opportunity to either prevent or control further spread of infection by SARS-CoV-2. These methods are especially important due to the ability of SARS-CoV-2 to infect persons through an airborne route.

This invention is based, at least in part, on unexpected broadly neutralizing activities of the disclosed anti-SARS-CoV-2 antibodies or antigen-binding fragments thereof. These antibodies and antigen-binding fragments constitute a novel therapeutic strategy in protection against SARS-CoV-2 infections.

Broadly Neutralizing Anti-SARS-COV-2 Antibodies

Antibodies

The invention disclosed herein involves broadly neutralizing anti-SARS-CoV-2 antibodies or antigen-binding fragments thereof. These antibodies refer to a class of neutralizing antibodies that neutralize multiple SARS-CoV-2 virus strains. The antibodies are able to protect a subject prophylactically and therapeutically against a lethal challenge with a SARS-CoV-2 virus.

In one aspect, this disclosure provides an isolated anti-SARS-CoV-2 antibody or antigen-binding fragment thereof that binds specifically to a SARS-CoV-2 antigen. In some embodiments, the SARS-CoV-2 antigen comprises a portion of a Spike (S) polypeptide, such as a S polypeptide of a human or an animal SARS-CoV-2. In some embodiments, the SARS-CoV-2 antigen comprises the receptor-binding domain (RBD) of the S polypeptide. In some embodiments, the RBD comprises amino acids 319-541 of the S polypeptide. In some embodiments, the antibody or antigen-binding fragment thereof is capable of neutralizing a plurality of SARS-CoV-2 strains.

In some embodiments, the antibody or antigen-binding fragment thereof is capable of neutralizing a SARS-CoV-2 virus at an IC50 concentration of less than 50 μg/ml.

The spike protein is important because it is present on the outside of intact SARS-CoV-2. Thus, it presents a target that can be used to inhibit or eliminate an intact virus before the virus has an opportunity to infect a cell. A representative amino acid sequence is provided below:

```
(Accession ID: NC_045512.2)
                                              (SEQ ID NO: 4599)
MFVFLVLLPLVSSQCVNLTTRTQLPPAYTNSFTRGVYYPDKVFRSSVLH

STQDLFLPFFSNVTWFHAIHVSGTNGTKRFDNPVLPFNDGVYFASTEKS

NIIRGWIFGTTLDSKTQSLLIVNNATNVVIKVCEFQFCNDPFLGVYYHK

NNKSWMESEFRVYSSANNCTFEYVSQPFLMDLEGKQGNFKNLREFVFKN

IDGYFKIYSKHTPINLVRDLPQGFSALEPLVDLPIGINITRFQTLLALH

RSYLTPGDSSSGWTAGAAAYYVGYLQPRTFLLKYNENGTITDAVDCALD

PLSETKCTLKSFTVEKGIYQTSNFRVQPTESIVRFPNITNLCPFGEVFN

ATRFASVYAWNRKRISNCVADYSVLYNSASFSTFKCYGVSPTKLNDLCF

TNVYADSFVIRGDEVRQIAPGQTGKIADYNYKLPDDFTGCVIAWNSNNL

DSKVGGNYNYLYRLFRKSNLKPFERDISTEIYQAGSTPCNGVEGFNCYF

PLQSYGFQPTNGVGYQPYRVVVLSFELLHAPATVCGPKKSTNLVKNKCV

NFNFNGLTGTGVLTESNKKFLPFQQFGRDIADTTDAVRDPQTLEILDIT

PCSFGGVSVITPGTNTSNQVAVLYQDVNCTEVPVAIHADQLTPTWRVYS

TGSNVFQTRAGCLIGAEHVNNSYECDIPIGAGICASYQTQTNSPRRARS

VASQSIIAYTMSLGAENSVAYSNNSIAIPTNFTISVTTEILPVSMTKTS

VDCTMYICGDSTECSNLLLQYGSFCTQLNRALTGIAVEQDKNTQEVFAQ

VKQIYKTPPIKDFGGFNFSQILPDPSKPSKRSFIEDLLFNKVTLADAGF

IKQYGDCLGDIAARDLICAQKFNGLTVLPPLLTDEMIAQYTSALLAGTI

TSGWTFGAGAALQIPFAMQMAYRFNGIGVTQNVLYENQKLIANQFNSAI

GKIQDSLSSTASALGKLQDVVNQNAQALNTLVKQLSSNFGAISSVLNDI

LSRLDKVEAEVQIDRLITGRLQSLQTYVTQQLIRAAEIRASANLAATKM

SECVLGQSKRVDFCGKGYHLMSFPQSAPHGVVFLHVTYVPAQEKNFTTA

PAICHDGKAHFPREGVFVSNGTHWFVTQRNFYEPQIITTDNTFVSGNCD

VVIGIVNNTVYDPLQPELDSFKEELDKYFKNHTSPDVDLGDISGINASV

VNIQKEIDRLNEVAKNLNESLIDLQELGKYEQYIKWPWYIWLGFIAGLI

AIVMVTIMLCCMTSCCSCLKGCCScGSCCKFDEDDSEPVLKGVKLHYT
```

Listed in Table 4A and Table 9 amino acid sequences of the heavy chain (HC) variable regions and light chain (LC) variable regions of exemplary antibodies.

In some embodiments, the antibody or antigen-binding fragment thereof comprises: (i) a heavy chain variable region having an amino acid sequence with at least 75% identity to one selected from Table 4A and Table 9; or (ii) a light chain variable region having an amino acid sequence with at least 75% identity to one selected from the table.

In some embodiments, the antibody or antigen-binding fragment thereof comprises: (i) a heavy chain variable region having an amino acid sequence with at least 75% identity to one selected from Table 4A and Table 9; and (ii) a light chain variable region having an amino acid sequence with at least 75% identity to one selected from Table 4A and Table 9.

In some embodiments, the antibody or antigen-binding fragment thereof comprises: (i) a heavy chain variable region having the amino acid sequence of one selected from Table 4A and Table 9; or (ii) a light chain variable region having the amino acid sequence of one selected from Table 4A and Table 9.

In some embodiments, the antibody or antigen-binding fragment thereof comprises: (i) a heavy chain variable region having the amino acid sequence of one selected from Table 4A and Table 9; and (ii) a light chain variable region having the amino acid sequence of one selected from Table 4A and Table 9.

In some embodiments, the antibody or antigen-binding fragment thereof comprises a heavy chain variable region, and a light chain variable region comprises the respective amino acid sequences of one pair selected from Table 4A and Table 9.

In some embodiments, the antibody or antigen-binding fragment thereof comprises: three heavy chain complementarity determining regions (HCDRs) (HCDR1, HCDR2, and HCDR3) of a heavy chain variable region having an amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, or 321; and three light chain CDRs (LCDR1, LCDR2, and LCDR3) of a light chain variable region having the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, or 322.

In some embodiments, the antibody or antigen-binding fragment thereof comprises: HCDR1, HCDR2, HCDR3, LCDR1, LCDR2, and LCDR3 comprising respective amino acid sequences of (a) SEQ ID NOs: 4600, 4601, 4602, 4603, 4604, and 4605; (b) SEQ ID NOs: 4606, 4607, 4608, 4609, 4610, and 4611; (c) SEQ ID Nos: 4612, 4613, 4614, 4615, 4616, and 4617; (d) SEQ ID NOs: 4618, 4619, 4620, 4621, 4622, and 4623; (e) SEQ ID NOs: 4624, 4625, 4626, 4627, 4628, and 4629; (f) SEQ ID NOs: 4630, 4631, 4632, 4633, 4634, and 4635; (g) SEQ ID NOs: 4636, 4637, 4638, 4639, 4640, and 4641; (h) SEQ ID NOs: 4642, 4643, 4644, 4645, 4646, and 4647; (i) SEQ ID NOs: 4648, 4649, 4650, 4651, 4652, and 4653; (j) SEQ ID NOs: 4654, 4655, 4656, 4657, 4658, and 4659; or (k) SEQ ID NOs: 4660, 4661, 4662, 4663, 4664, and 4665.

In some embodiments, The antibody or antigen-binding fragment thereof comprises: (i) a heavy chain variable region having an amino acid sequence with at least 75% identity to the amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, or 321; or having the amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, or 321; and (ii) a light chain variable region having an amino acid sequence with at least 75% identity to the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, or 322; or having the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, or 322.

In some embodiments, the antibody or antigen-binding fragment thereof comprises a heavy chain variable region and a light chain variable region that comprise the respective amino acid sequences of SEQ ID NOs: 1-2, 3-4, 5-6, 7-8, 9-10, 11-12, 13-14, 15-16, 17-18, 19-20, 21-22, 23-24, 25-26, 27-28, 29-30, 31-32, 33-34, 35-36, 37-38, 39-40, 41-42, 43-44, 45-46, 47-48, 49-50, 51-52, 53-54, 55-56, 57-58, 59-60, 61-62, 63-64, 65-66, 67-68, 69-70, 71-72, 73-74, 75-76, 77-78, 79-80, 81-82, 83-84, 85-86, 87-88, 89-90, 91-92, 93-94, 95-96, 97-98, 99-100, 101-102, 103-104, 105-106, 107-108, 109-110, 111-112, 113-114, 115-116, 117-118, 119-120, 121-122, 123-124, 125-126, 127-128, 129-130, 131-132, 133-134, 135-136, 137-138, 139-140, 141-142, 143-144, 145-146, 147-148, 149-150, 151-152, 153-154, 155-156, 157-158, 159-160, 161-162, 163-164, 165-166, 167-168, 169-170, 171-172, 173-174, 175-176, 177-178, 179-180, 181-182, 183-184, 185-186, 187-188, 189-190, 191-192, 193-194, 195-196, 197-198, 199-200, 201-202, 203-204, 205-206, 207-208, 209-210, 211-212, 213-214, 215-216, 217-218, 219-220, 221-222, 223-224, 225-226, 227-228, 229-230, 231-232, 233-234, 235-236, 237-238, 239-240, 241-242, 243-244, 245-246, 247-248, 249-250, 251-252, 253-254, 255-256, 257-258, 259-260, 261-262, 263-264, 265-266, 267-268, 269-270, 271-272, 273-274, 275-276, 277-278, 279-280, 281-282, 283-284, 285-286, 287-288, 289-290, 291-292, 293-294, 295-296, 297-298, 299-300, 301-302, 303-304, 305-306, 307-308, 309-310, 311-312, 313-314, 315-316, 317-318, 319-320, or 321-322.

In some embodiments, the antibody or antigen-binding fragment thereof comprises a heavy chain variable region and a light chain variable region that comprise the respective amino acid sequences of SEQ ID NOs: 3-4, 11-12, 141-142, 143-144, 189-190, 311-312, 313-314, 315-316, 317-318, 319-320, or 321-322.

In some embodiments, the antibody or antigen-binding fragment thereof comprises (a) a first target binding site that specifically binds to an epitope within the S polypeptide, and (b) a second target binding site that binds to a different epitope on the S polypeptide or on a different molecule. In some embodiments, the multivalent antibody is a bivalent or bispecific antibody.

In some embodiments, the antibody or the antigen-binding fragment thereof further comprises a variant Fc constant region. In some embodiments, the antibody is a monoclonal antibody. In some embodiments, the antibody is a chimeric antibody, a humanized antibody, or a humanized monoclonal antibody. In some embodiments, the antibody is a single-chain antibody, Fab or Fab2 fragment.

In some embodiments, the antibody or the antigen-binding fragment thereof further comprises a variant Fc constant region. The antibody can be a monoclonal antibody. In some embodiments, the antibody can be a chimeric antibody, a humanized antibody, or a humanized monoclonal antibody. In some embodiments, the antibody can be a single-chain antibody, Fab or Fab2 fragment.

In some embodiments, the antibody or antigen-binding fragment thereof can be detectably labeled or conjugated to a toxin, a therapeutic agent, a polymer (e.g., polyethylene glycol (PEG)), a receptor, an enzyme or a receptor ligand. For example, an antibody of the present invention may be coupled to a toxin (e.g., a tetanus toxin). Such antibodies may be used to treat animals, including humans, that are infected with the virus that is etiologically linked to SARS- CoV-2. The toxin-coupled antibody is thought to bind to a portion of a spike protein presented on an infected cell, and then kill the infected cell.

In another example, an antibody of the present invention may be coupled to a detectable tag. Such antibodies may be used within diagnostic assays to determine if an animal, such as a human, is infected with SARS-CoV-2. Examples of detectable tags include: fluorescent proteins (i.e., green fluorescent protein, red fluorescent protein, yellow fluorescent protein), fluorescent markers (i.e., fluorescein isothiocyanate, rhodamine, texas red), radiolabels (i.e., 3H, 32P, 125I), enzymes (i.e., β-galactosidase, horseradish peroxidase, β-glucuronidase, alkaline phosphatase), or an affinity tag (i.e., avidin, biotin, streptavidin). Methods to couple antibodies to a detectable tag are known in the art. Harlow et al., Antibodies: A Laboratory Manual, page 319 (Cold Spring Harbor Pub. 1988).

Fragment

In some embodiments, an antibody provided herein is an antibody fragment. Antibody fragments include, but are not limited to, Fab, Fab', Fab'-SH, F(ab')2, Fv, and single-chain Fv (scFv) fragments, and other fragments described below, e.g., diabodies, triabodies tetrabodies, and single-domain antibodies. For a review of certain antibody fragments, see Hudson et al., Nat. Med. 9:129-134 (2003). For a review of scFv fragments, see, e.g., Pluckthun, in The Pharmacology of Monoclonal Antibodies, vol. 113, Rosenburg and Moore eds., (Springer-Verlag, New York), pp. 269-315 (1994); see also WO 93/16185; and U.S. Pat. Nos. 5,571,894 and 5,587,458. For discussion of Fab and F(ab')2 fragments comprising salvage receptor binding epitope residues and having increased in vivo half-life, see U.S. Pat. No. 5,869,046.

Diabodies are antibody fragments with two antigen-binding sites that may be bivalent or bispecific. See, for example, EP 404,097; WO 1993/01161; Hudson et al., Nat. Med. 9:129-134 (2003); and Hollinger et al., Proc. Natl. Acad. Sci. USA 90: 6444-6448 (1993). Triabodies and tetrabodies are also described in Hudson et al., Nat. Med. 9:129-134 (2003).

Single-domain antibodies are antibody fragments comprising all or a portion of the heavy chain variable domain or all or a portion of the light chain variable domain of an antibody. In some embodiments, a single-domain antibody is a human single-domain antibody (DOMANTIS, Inc., Waltham, Mass.; see, e.g., U.S. Pat. No. 6,248,516).

Antibody fragments can be made by various techniques, including but not limited to proteolytic digestion of an intact antibody as well as production by recombinant host cells (e.g., *E. coli* or phage), as described herein.

Chimeric and Humanized Antibodies

In some embodiments, an antibody provided herein is a chimeric antibody. Certain chimeric antibodies are described, e.g., in U.S. Pat. No. 4,816,567; and Morrison et al., Proc. Natl. Acad. Sci. USA, 81:6851-6855 (1984)). In one example, a chimeric antibody comprises a non-human variable region (e.g., a variable region derived from a mouse, rat, hamster, rabbit, or non-human primate, such as a monkey) and a human constant region. In a further example, a chimeric antibody is a "class switched" antibody in which the class or subclass has been changed from that of the parent antibody. Chimeric antibodies include antigen-binding fragments thereof.

In some embodiments, a chimeric antibody is a humanized antibody. Typically, a non-human antibody is humanized to reduce immunogenicity to humans, while retaining the specificity and affinity of the parental non-human antibody. Generally, a humanized antibody comprises one or more variable domains in which HVRs, e.g., CDRs, (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody are substituted with corresponding residues from a non-human antibody (e.g., the antibody from which the HVR residues are derived), e.g., to restore or improve antibody specificity or affinity.

Humanized antibodies and methods of making them are reviewed, e.g., in Almagro and Fransson, Front. Biosci. 13:1619-1633 (2008), and are further described, e.g., in Riechmann et al., Nature 332:323-329 (1988); Queen et al., Proc. Nat'l Acad. Sci. USA 86:10029-10033 (1989); U.S. Pat. Nos. 5,821,337, 7,527,791, 6,982,321, and 7,087,409; Kashmiri et al., Methods 36:25-34 (2005) (describing specificity determining region (SDR) grafting); Padlan, Mol. Immunol. 28:489-498 (1991) (describing "resurfacing"); Dall'Acqua et al., Methods 36:43-60 (2005) (describing "FR shuffling"); and Osbourn et al., Methods 36:61-68 (2005) and Klimka et al., Br. J. Cancer, 83:252-260 (2000) (describing the "guided selection" approach to FR shuffling).

Human framework regions that may be used for humanization include but are not limited to: framework regions selected using the "best-fit" method (see, e.g., Sims et al. J. Immunol. 151:2296 (1993)); framework regions derived from the consensus sequence of human antibodies of a particular subgroup of light or heavy chain variable regions (see, e.g., Carter et al. Proc. Natl. Acad. Sci. USA, 89:4285 (1992); and Presta et al. J. Immunol., 151:2623 (1993)); human mature (somatically mutated) framework regions or human germline framework regions (see, e.g., Almagro and Fransson, Front. Biosci. 13:1619-1633 (2008)); and framework regions derived from screening FR libraries (see, e.g., Baca et al., J. Biol. Chem. 272:10678-10684 (1997) and Rosok et al., J. Biol. Chem. 271:22611-22618 (1996)).

Human Antibodies

In some embodiments, an antibody provided herein is a human antibody. Human antibodies can be produced using various techniques known in the art or using techniques described herein. Human antibodies are described generally in van Dijk and van de Winkel, Curr. Opin. Pharmacol. 5: 368-74 (2001) and Lonberg, Curr. Opin. Immunol. 20:450-459 (2008).

Human antibodies may be prepared by administering an immunogen to a transgenic animal that has been modified to produce intact human antibodies or intact antibodies with human variable regions in response to antigenic challenge. Such animals typically contain all or a portion of the human immunoglobulin loci, which replace the endogenous immunoglobulin loci, or which are present extrachromosomally or integrated randomly into the animal's chromosomes. In such transgenic mice, the endogenous immunoglobulin loci have generally been inactivated. For a review of methods for obtaining human antibodies from transgenic animals, see Lonberg, Nat. Biotech. 23:1117-1125 (2005). See also, e.g., U.S. Pat. Nos. 6,075,181 and 6,150,584 describing XENOMOUSE technology; U.S. Pat. No. 5,770,429 describing HUMAB technology; U.S. Pat. No. 7,041,870 describing K-M MOUSE technology, and U.S. Patent Application Publication No. US 2007/0061900, describing VELOCIMOUSE technology). Human variable regions from intact antibodies generated by such animals may be further modified, e.g., by combining with a different human constant region.

Human antibodies can also be made by hybridoma-based methods. Human myeloma and mouse-human heteromyeloma cell lines for the production of human monoclonal antibodies have been described. (See, e.g., Kozbor J. Immunol., 133: 3001 (1984); Brodeur et al., Monoclonal Antibody Production Techniques and Applications, pp. 51-63 (Marcel Dekker, Inc., New York, 1987); and Boerner et al., J. Immunol., 147: 86 (1991).) Human antibodies generated via human B-cell hybridoma technology are also described in Li et al., Proc. Natl. Acad. Sci. USA, 103:3557-3562 (2006). Additional methods include those described, for example, in U.S. Pat. No. 7,189,826 (describing production of monoclonal human IgM antibodies from hybridoma cell lines) and Ni, Xiandai Mianyixue, 26(4):265-268 (2006) (describing human-human hybridomas). Human hybridoma technology (Trioma technology) is also described in Vollmers and Brandlein, Histology and Histopathology, 20(3):927-937 (2005) and Vollmers and Brandlein, Methods and Findings in Experimental and Clinical Pharmacology, 27(3):185-91 (2005).

Human antibodies may also be generated by isolating Fv clone variable domain sequences selected from human-derived phage display libraries. Such variable domain sequences may then be combined with a desired human constant domain. Techniques for selecting human antibodies from antibody libraries are described below.

Antibodies of the invention may be isolated by screening combinatorial libraries for antibodies with the desired activity or activities. For example, a variety of methods are known in the art for generating phage display libraries and screening such libraries for antibodies possessing the desired binding characteristics. Such methods are reviewed, e.g., in Hoogenboom et al., in Methods in Molecular Biology 178: 1-37 (O'Brien et al., ed., Human Press, Totowa, N.J., 2001) and further described, e.g., in the McCafferty et al., Nature 348:552-554; Clackson et al., Nature 352: 624-628 (1991); Marks et al., J. Mol. Biol. 222: 581-597 (1992); Marks and Bradbury, in Methods in Molecular Biology 248:161-175 (Lo, ed., Human Press, Totowa, N.J., 2003); Sidhu et al., J. Mol. Biol. 338(2): 299-310 (2004); Lee et al., J. Mol. Biol. 340(5): 1073-1093 (2004); Fellouse, Proc. Natl. Acad. Sci. USA 101(34): 12467-12472 (2004); and Lee et al., J. Immunol. Methods 284(1-2): 119-132 (2004).

In certain phage display methods, repertoires of VH and VL genes are separately cloned by polymerase chain reaction (PCR) and recombined randomly in phage libraries, which can then be screened for antigen-binding phage as described in Winter et al., Ann. Rev. Immunol., 12: 433-455 (1994). Phage typically displays antibody fragments, either as scFv fragments or as Fab fragments. Libraries from immunized sources provide high-affinity antibodies to the immunogen without the requirement of constructing hybridomas. Alternatively, the naive repertoire can be cloned (e.g., from human) to provide a single source of antibodies to a wide range of non-self and also self-antigens without any immunization as described by Griffiths et al., EMBO J, 12: 725-734 (1993). Finally, naive libraries can also be made synthetically by cloning unrearranged V-gene segments from stem cells and using PCR primers containing random sequence to encode the highly variable CDR3 regions and to accomplish rearrangement in vitro, as described by Hoogenboom and Winter, J. Mol. Biol., 227: 381-388 (1992). Patent publications describing human antibody phage libraries include, for example, U.S. Pat. No. 5,750,373, and US Patent Publication Nos. 2005/0079574, 2005/0119455, 2005/0266000, 2007/0117126, 2007/0160598, 2007/0237764, 2007/0292936, and 2009/0002360. Antibodies or antibody fragments isolated from human antibody libraries are considered human antibodies or human antibody fragments herein.

Variants

In some embodiments, amino acid sequence variants of the antibodies provided herein are contemplated. For example, it may be desirable to improve the binding affinity and/or other biological properties of the antibody. Amino acid sequence variants of an antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen binding.

Substitution, Insertion, and Deletion Variants

In some embodiments, antibody variants having one or more amino acid substitutions are provided. Sites of interest for substitutional mutagenesis include the HVRs and FRs. Conservative substitutions are defined herein. Amino acid substitutions may be introduced into an antibody of interest and the products screened for a desired activity, e.g., retained/improved antigen binding, decreased immunogenicity, or improved antibody-dependent cell-mediated cytotoxicity (ADCC) and complement-dependent cytotoxicity (CDC).

Accordingly, an antibody of the invention can comprise one or more conservative modifications of the CDRs, heavy chain variable region, or light variable regions described herein. A conservative modification or functional equivalent of a peptide, polypeptide, or protein disclosed in this invention refers to a polypeptide derivative of the peptide, polypeptide, or protein, e.g., a protein having one or more point mutations, insertions, deletions, truncations, a fusion protein, or a combination thereof. It substantially retains the activity to of the parent peptide, polypeptide, or protein (such as those disclosed in this invention). In general, a conservative modification or functional equivalent is at least 60% (e.g., any number between 60% and 100%, inclusive, e.g., 60%, 70%, 75%, 80%, 85%, 90%, 95%, 96%, 97%, 98%, and 99%) identical to a parent. Accordingly, within the scope of this invention are heavy chain variable region or light variable regions having one or more point mutations, insertions, deletions, truncations, a fusion protein, or a combination thereof, as well as antibodies having the variant regions.

As used herein, the percent homology between two amino acid sequences is equivalent to the percent identity between the two sequences. The percent identity between the two sequences is a function of the number of identical positions shared by the sequences (i.e., % homology=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two amino acid sequences can be determined using the algorithm of E. Meyers and W. Miller (Comput. Appl. Biosci., 4:11-17 (1988)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (J. Mol. Biol. 48:444-453 (1970)) algorithm which has been incorporated into the GAP program in the GCG software package (available at www.gcg.com), using either a Blossum 62 matrix or a PAM250 matrix, and a gap weight of 16, 14, 12, 10, 8, 6, or 4 and a length weight of 1, 2, 3, 4, 5, or 6.

Additionally or alternatively, the protein sequences of the present invention can further be used as a "query sequence" to perform a search against public databases to, for example, identify related sequences. Such searches can be performed using the XBLAST program (version 2.0) of Altschul, et al. (1990) J. Mol. Biol. 215:403-10. BLAST protein searches can be performed with the XBLAST program, score=50, wordlength=3 to obtain amino acid sequences homologous to the antibody molecules of the invention. To obtain gapped alignments for comparison purposes, Gapped BLAST can be utilized as described in Altschul et al., (1997) Nucleic Acids Res. 25(17):3389-3402. When utilizing BLAST and Gapped BLAST programs, the default parameters of the respective programs (e.g., XBLAST and NBLAST) can be used. (See www.ncbi.nlm.nih.gov).

As used herein, the term "conservative modifications" refers to amino acid modifications that do not significantly affect or alter the binding characteristics of the antibody containing the amino acid sequence. Such conservative modifications include amino acid substitutions, additions and deletions. Modifications can be introduced into an antibody of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include: (i) amino acids with basic side chains (e.g., lysine, arginine, histidine), (ii) acidic side chains (e.g., aspartic acid, glutamic acid), (iii) uncharged polar side chains (e.g., glycine, asparagine, glutamine, serine, threonine, tyrosine, cysteine, tryptophan), (iv) nonpolar side chains (e.g., alanine, valine, leucine, isoleucine, proline, phenylalanine, methionine), (v) beta-branched side chains (e.g., threonine, valine, isoleucine), and (vi) aromatic side chains (e.g., tyrosine, phenylalanine, tryptophan, histidine).

Non-conservative substitutions will entail exchanging a member of one of these classes for another class.

An exemplary substitutional variant is an affinity matured antibody, which may be conveniently generated, e.g., using phage display-based affinity maturation techniques such as those described in, e.g., Hoogenboom et al., in Methods in Molecular Biology 178:1-37 (O'Brien et al., ed., Human Press, Totowa, N.J., (2001). Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme (e.g., for ADEPT) or a polypeptide which increases the serum half-life of the antibody.

Glycosylation Variants

In some embodiments, an antibody provided herein is altered to increase or decrease the extent to which the antibody is glycosylated. Addition or deletion of glycosylation sites to an antibody may be conveniently accomplished by altering the amino acid sequence such that one or more glycosylation sites are created or removed.

For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region framework glycosylation sites to thereby eliminate glycosylation at that site. Such aglycosylation may increase the affinity of the antibody for antigen. Such an approach is described in further detail in U.S. Pat. Nos. 5,714,350 and 6,350,861 by Co et al.

Glycosylation of the constant region on N297 may be prevented by mutating the N297 residue to another residue, e.g., N297A, and/or by mutating an adjacent amino acid, e.g., 298 to thereby reduce glycosylation on N297.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies described herein to thereby produce an antibody with altered glycosylation. For example, EP 1,176,195 by Hanai et al. describes a cell line with a functionally disrupted FUT8 gene, which encodes a fucosyltransferase, such that antibodies expressed in such a cell line exhibit hypofucosylation. PCT Publication WO 03/035835 by Presta describes a variant Chinese Hamster Ovary cell line, Led 3 cells, with reduced ability to attach fucose to Asn(297)-linked carbohydrates, also resulting in hypofucosylation of antibodies expressed in that host cell (see also Shields, R. L. et al. (2002) J. Biol. Chem. 277:26733-26740). PCT Publication WO 99/54342 by Umana et al. describes cell lines engineered to express glycoprotein-modifying glycosyltransferases (e.g., beta(1,4)-N-acetylglucosaminyltransferase III (GnTIII)) such that antibodies expressed in the engineered cell lines exhibit increased bisecting GlcNac structures which result in increased ADCC activity of the antibodies (see also Umana et al. (1999) Nat. Biotech. 17: 176-180).

Fc Region Variants

The variable regions of the antibody described herein can be linked (e.g., covalently linked or fused) to an Fc, e.g., an IgG1, IgG2, IgG3 or IgG4 Fc, which may be of any allotype or isoallotype, e.g., for IgG1: G1m, G1m1(a), G1m2(x), G1m3(f), G1m17(z); for IgG2: G2m, G2m23(n); for IgG3: G3m, G3m21(g1), G3m28(g5), G3m11(b0), G3m5(b1), G3m13(b3), G3m14(b4), G3m10(b5), G3m15(s), G3m16 (t), G3m6(c3), G3m24(c5), G3m26(u), G3m27(v); and for K: Km, Km1, Km2, Km3 (see, e.g., Jefferies et al. (2009) mAbs 1: 1). In some embodiments, the antibodies variable regions described herein are linked to an Fc that binds to one or more activating Fc receptors (FcγI, Fcγlla or FcγIIIa), and thereby stimulate ADCC and may cause T cell depletion. In some embodiments, the antibody variable regions described herein are linked to an Fc that causes depletion.

In some embodiments, the antibody variable regions described herein may be linked to an Fc comprising one or more modifications, typically to alter one or more functional properties of the antibody, such as serum half-life, complement fixation, Fc receptor binding, and/or antigen-dependent cellular cytotoxicity. Furthermore, an antibody described herein may be chemically modified (e.g., one or more chemical moieties can be attached to the antibody) or be modified to alter its glycosylation, to alter one or more functional properties of the antibody. The numbering of residues in the Fc region is that of the EU index of Kabat.

The Fc region encompasses domains derived from the constant region of an immunoglobulin, preferably a human immunoglobulin, including a fragment, analog, variant, mutant or derivative of the constant region. Suitable immunoglobulins include IgG1, IgG2, IgG3, IgG4, and other classes such as IgA, IgD, IgE, and IgM. The constant region of an immunoglobulin is defined as a naturally-occurring or synthetically-produced polypeptide homologous to the immunoglobulin C-terminal region, and can include a CH1 domain, a hinge, a CH2 domain, a CH3 domain, or a CH4 domain, separately or in combination. In some embodiments, an antibody of this invention has an Fc region other than that of a wild type IgA1. The antibody can have an Fc region from that of IgG (e.g., IgG1, IgG2, IgG3, and IgG4) or other classes such as IgA2, IgD, IgE, and IgM. The Fc can be a mutant form of IgA1.

The constant region of an immunoglobulin is responsible for many important antibody functions, including Fc receptor (FcR) binding and complement fixation. There are five major classes of heavy chain constant region, classified as IgA, IgG, IgD, IgE, IgM, each with characteristic effector functions designated by isotype. For example, IgG is separated into four subclasses known as IgG1, IgG2, IgG3, and IgG4.

Ig molecules interact with multiple classes of cellular receptors. For example, IgG molecules interact with three classes of Fcγ receptors (FcγR) specific for the IgG class of antibody, namely FcγRI, FcγRII, and FcγRIIL The important sequences for the binding of IgG to the FcγR receptors have been reported to be located in the CH2 and CH3 domains. The serum half-life of an antibody is influenced by the ability of that antibody to bind to an FcR.

In some embodiments, the Fc region is a variant Fc region, e.g., an Fc sequence that has been modified (e.g., by amino acid substitution, deletion and/or insertion) relative to a parent Fc sequence (e.g., an unmodified Fc polypeptide that is subsequently modified to generate a variant), to provide desirable structural features and/or biological activity. For example, one may make modifications in the Fc region in order to generate an Fc variant that (a) has increased or decreased ADCC, (b) increased or decreased CDC, (c) has increased or decreased affinity for Clq and/or (d) has increased or decreased affinity for an Fc receptor relative to the parent Fc. Such Fc region variants will generally comprise at least one amino acid modification in the Fc region. Combining amino acid modifications is thought to be particularly desirable. For example, the variant Fc region may include two, three, four, five, etc., substitutions therein, e.g., of the specific Fc region positions identified herein.

A variant Fc region may also comprise a sequence alteration wherein amino acids involved in disulfide bond formation are removed or replaced with other amino acids. Such removal may avoid reaction with other cysteine-containing proteins present in the host cell used to produce the antibodies described herein. Even when cysteine residues are removed, single chain Fc domains can still form a dimeric Fc domain that is held together non-covalently. In other embodiments, the Fc region may be modified to make it more compatible with a selected host cell. For example, one may remove the PA sequence near the N-terminus of a typical native Fc region, which may be recognized by a digestive enzyme in *E. coli* such as proline iminopeptidase. In other embodiments, one or more glycosylation sites within the Fc domain may be removed. Residues that are typically glycosylated (e.g., asparagine) may confer cytolytic response. Such residues may be deleted or substituted with unglycosylated residues (e.g., alanine). In other embodiments, sites involved in interaction with complement, such as the Clq binding site, may be removed from the Fc region. For example, one may delete or substitute the EKK sequence of human IgG1. In some embodiments, sites that affect binding to Fc receptors may be removed, preferably sites other than salvage receptor binding sites. In other embodiments, an Fc region may be modified to remove an ADCC site. ADCC sites are known in the art; see, for example, Molec. Immunol. 29 (5): 633-9 (1992) with regard to ADCC sites in IgG1. Specific examples of variant Fc domains are disclosed, for example, in WO 97/34631 and WO 96/32478.

In one embodiment, the hinge region of Fc is modified such that the number of cysteine residues in the hinge region is altered, e.g., increased or decreased. This approach is described further in U.S. Pat. No. 5,677,425 by Bodmer et al. The number of cysteine residues in the hinge region of Fc is altered to, for example, facilitate assembly of the light and heavy chains or to increase or decrease the stability of the antibody. In one embodiment, the Fc hinge region of an antibody is mutated to decrease the biological half-life of the antibody. More specifically, one or more amino acid mutations are introduced into the CH2-CH3 domain interface region of the Fc-hinge fragment such that the antibody has impaired Staphylococcal protein A (SpA) binding relative to native Fc-hinge domain SpA binding. This approach is described in further detail in U.S. Pat. No. 6,165,745 by Ward et al.

In yet other embodiments, the Fc region is altered by replacing at least one amino acid residue with a different amino acid residue to alter the effector function(s) of the antibody. For example, one or more amino acids selected from amino acid residues 234, 235, 236, 237, 297, 318, 320, and 322 can be replaced with a different amino acid residue such that the antibody has an altered affinity for an effector ligand but retains the antigen-binding ability of the parent antibody. The effector ligand to which affinity is altered can be, for example, an Fc receptor or the CI component of complement. This approach is described in further detail in U.S. Pat. Nos. 5,624,821 and 5,648,260, both by Winter et al.

In another example, one or more amino acids selected from amino acid residues 329, 331, and 322 can be replaced with a different amino acid residue such that the antibody has altered Clq binding and/or reduced or abolished CDC. This approach is described in further detail in U.S. Pat. No. 6,194,551 by Idusogie et al.

In another example, one or more amino acid residues within amino acid positions 231 and 239 are altered to thereby alter the ability of the antibody to fix complement. This approach is described further in PCT Publication WO 94/29351 by Bodmer et al.

In yet another example, the Fc region may be modified to increase ADCC and/or to increase the affinity for an Fcγ receptor by modifying one or more amino acids at the following positions: 234, 235, 236, 238, 239, 240, 241, 243, 244, 245, 247, 248, 249, 252, 254, 255, 256, 258, 262, 263, 264, 265, 267, 268, 269, 270, 272, 276, 278, 280, 283, 285, 286, 289, 290, 292, 293, 294, 295, 296, 298, 299, 301, 303, 305, 307, 309, 312, 313, 315, 320, 322, 324, 325, 326, 327, 329, 330, 331, 332, 333, 334, 335, 337, 338, 340, 360, 373, 376, 378, 382, 388, 389, 398, 414, 416, 419, 430, 433, 434, 435, 436, 437, 438 or 439. Exemplary substitutions include 236A, 239D, 239E, 268D, 267E, 268E, 268F, 324T, 332D, and 332E. Exemplary variants include 239D/332E, 236A/332E, 236A/239D/332E, 268F/324T, 267E/268F, 267E/324T, and 267E/268F7324T. Other modifications for enhancing FcγR and complement interactions include but are not limited to substitutions 298A, 333A, 334A, 326A, 247I, 339D, 339Q, 280H, 290S, 298D, 298V, 243L, 292P, 300L, 396L, 305I, and 396L. These and other modifications are reviewed in Strohl, 2009, Current Opinion in Biotechnology 20:685-691.

Fc modifications that increase binding to an Fcγ receptor include amino acid modifications at any one or more of amino acid positions 238, 239, 248, 249, 252, 254, 255, 256, 258, 265, 267, 268, 269, 270, 272, 279, 280, 283, 285, 298, 289, 290, 292, 293, 294, 295, 296, 298, 301, 303, 305, 307, 312, 315, 324, 327, 329, 330, 335, 337, 3338, 340, 360, 373, 376, 379, 382, 388, 389, 398, 414, 416, 419, 430, 434, 435, 437, 438 or 439 of the Fc region, wherein the numbering of the residues in the Fc region is that of the EU index as in abat (WO00/42072).

Other Fc modifications that can be made to Fcs are those for reducing or ablating binding to FcγR and/or complement proteins, thereby reducing or ablating Fc-mediated effector functions such as ADCC, antibody-dependent cellular phagocytosis (ADCP), and CDC. Exemplary modifications include but are not limited substitutions, insertions, and deletions at positions 234, 235, 236, 237, 267, 269, 325, and 328, wherein numbering is according to the EU index. Exemplary substitutions include but are not limited to 234G, 235G, 236R, 237K, 267R, 269R, 325L, and 328R, wherein numbering is according to the EU index. An Fc variant may comprise 236R/328R. Other modifications for reducing FcγR and complement interactions include substitutions 297A, 234A, 235A, 237A, 318A, 228P, 236E, 268Q, 309L, 330S, 331S, 220S, 226S, 229S, 238S, 233P, and 234V, as well as removal of the glycosylation at position 297 by mutational or enzymatic means or by production in organisms such as bacteria that do not glycosylate proteins. These and other modifications are reviewed in Strohl, 2009, Current Opinion in Biotechnology 20:685-691.

Optionally, the Fc region may comprise a non-naturally occurring amino acid residue at additional and/or alternative positions known to one skilled in the art (see, e.g., U.S. Pat. Nos. 5,624,821; 6,277,375; 6,737,056; 6,194,551; 7,317,091; 8,101,720; WO00/42072; WO01/58957; WO02/06919; WO04/016750; WO04/029207; WO04/035752; WO04/074455; WO04/099249; WO04/063351; WO05/070963; WO05/040217, WO05/092925 and WO06/020114).

Fc variants that enhance affinity for an inhibitory receptor FcγRIIb may also be used. Such variants may provide an Fc fusion protein with immune-modulatory activities related to FcγRIIb cells, including, for example, B cells and monocytes. In one embodiment, the Fc variants provide selectively enhanced affinity to FcγRIIb relative to one or more activating receptors. Modifications for altering binding to FcγRIIb include one or more modifications at a position selected from the group consisting of 234, 235, 236, 237, 239, 266, 267, 268, 325, 326, 327, 328, and 332, according to the EU index. Exemplary substitutions for enhancing FcγRIIb affinity include but are not limited to 234D, 234E, 234F, 234W, 235D, 235F, 235R, 235Y, 236D, 236N, 237D, 237N, 239D, 239E, 266M, 267D, 267E, 268D, 268E, 327D, 327E, 328F, 328W, 328Y, and 332E. Exemplary substitutions include 235Y, 236D, 239D, 266M, 267E, 268D, 268E, 328F, 328W, and 328Y. Other Fc variants for enhancing binding to FcγRllb include 235Y/267E, 236D/267E, 239D/268D, 239D/267E, 267E/268D, 267E/268E, and 267E/328F.

The affinities and binding properties of an Fc region for its ligand may be determined by a variety of in vitro assay methods (biochemical or immunological based assays) known in the art including but not limited to, equilibrium methods (e.g., ELISA, or radioimmunoassay), or kinetics (e.g., BIACORE analysis), and other methods such as indirect binding assays, competitive inhibition assays, fluorescence resonance energy transfer (FRET), gel electrophoresis and chromatography (e.g., gel filtration). These and other methods may utilize a label on one or more of the components being examined and/or employ a variety of detection methods including but not limited to chromogenic, fluorescent, luminescent, or isotopic labels. A detailed description of binding affinities and kinetics can be found in Paul, W. E., ed., Fundamental Immunology, 4th Ed., Lippincott-Raven, Philadelphia (1999), which focuses on antibody-immunogen interactions.

In some embodiments, the antibody is modified to increase its biological half-life. Various approaches are possible. For example, this may be done by increasing the binding affinity of the Fc region for FcRn. For example, one or more of the following residues can be mutated: 252, 254, 256, 433, 435, 436, as described in U.S. Pat. No. 6,277,375. Specific exemplary substitutions include one or more of the following: T252L, T254S, and/or T256F. Alternatively, to increase the biological half-life, the antibody can be altered within the CH1 or CL region to contain a salvage receptor binding epitope taken from two loops of a CH2 domain of an Fc region of an IgG, as described in U.S. Pat. Nos. 5,869,046 and 6,121,022 by Presta et al. Other exemplary variants that increase binding to FcRn and/or improve pharmacokinetic properties include substitutions at positions 259, 308, 428, and 434, including for example 259I, 308F, 428L, 428M, 434S, 434H, 434F, 434Y, and 434M. Other variants that increase Fc binding to FcRn include: 250E, 250Q, 428L, 428F, 250Q/428L (Hinton et al, 2004, J. Biol. Chem. 279(8): 6213-6216, Hinton et al. 2006 Journal of Immunology 176:346-356), 256A, 272A, 286A, 305A, 307A, 307Q, 311A, 312A, 376A, 378Q, 380A, 382A, 434A (Shields et al, Journal of Biological Chemistry, 2001, 276 (9):6591-6604), 252F, 252T, 252Y, 252W, 254T, 256S, 256R, 256Q, 256E, 256D, 256T, 309P, 311S, 433R, 433S, 433I, 433P, 433Q, 434H, 434F, 434Y, 252Y/254T/256E, 433K/434F/436H, 308T/309P/311S (Dall Acqua et al. Journal of Immunology, 2002, 169:5171-5180, Dall'Acqua et al., 2006, Journal of Biological Chemistry 281:23514-23524). Other modifications for modulating FcRn binding are described in Yeung et al., 2010, J Immunol, 182:7663-7671. In some embodiments, hybrid IgG isotypes with particular biological characteristics may be used. For example, an IgG1/IgG3 hybrid variant may be constructed by substituting IgG 1 positions in the CH2 and/or CH3 region with the amino acids from IgG3 at positions where the two isotypes differ. Thus a hybrid variant IgG antibody may be constructed that comprises one or more substitutions, e.g., 274Q, 276K, 300F, 339T, 356E, 358M, 384S, 392N, 397M, 422I, 435R, and 436F. In other embodiments described herein, an IgG1/IgG2 hybrid variant may be constructed by substituting IgG2 positions in the CH2 and/or CH3 region with amino acids from IgG1 at positions where the two isotypes differ. Thus a hybrid variant IgG antibody may be constructed chat comprises one or more substitutions, e.g., one or more of the following amino acid substitutions: 233E, 234L, 235L, 236G (referring to an insertion of a glycine at position 236), and 321 h.

Moreover, the binding sites on human IgG1 for FcγRl, FcγRII, FcγRIII, and FcRn have been mapped and variants with improved binding have been described (see Shields, R. L. et al. (2001) J. Biol. Chem. 276:6591-6604). Specific mutations at positions 256, 290, 298, 333, 334, and 339 were shown to improve binding to FcγRIII Additionally, the following combination mutants were shown to improve FcγRIII binding: T256A/S298A, S298A/E333A, S298A/K224A, and S298A/E333A/K334A, which has been shown to exhibit enhanced FcγRIIIa binding and ADCC activity (Shields et al., 2001). Other IgG1 variants with strongly enhanced binding to FcγRIIIa have been identified, including variants with S239D/I332E and S239D/I332E/A330L mutations which showed the greatest increase in affinity for FcγRIIIa, a decrease in FcγRIIb binding, and strong cytotoxic activity in cynomolgus monkeys (Lazar et al., 2006). Introduction of the triple mutations into antibodies such as alemtuzumab (CD52-specific), trastuzumab (HER2/neu-specific), rituximab (CD20-specific), and cetuximab (EGFR-specific) translated into greatly enhanced ADCC activity in vitro, and the S239D/I332E variant showed an enhanced capacity to deplete B cells in monkeys (Lazar et al., 2006). In addition, IgG1 mutants containing L235V, F243L, R292P, Y300L and P396L mutations which exhibited enhanced binding to FcγRIIIa and concomitantly enhanced ADCC activity in transgenic mice expressing human FcγRIIIa in models of B cell malignancies and breast cancer have been identified (Stavenhagen et al., 2007; Nordstrom et al., 2011). Other Fc mutants that may be used include: S298A/E333A/L334A, S239D/I332E, S239D/I332E/A330L, L235V/F243L/R292P/Y300L/P396L, and M428L/N434S.

In some embodiments, an Fc is chosen that has reduced binding to FcγRs. An exemplary Fc, e.g., IgG1 Fc, with reduced FcγR binding, comprises the following three amino acid substitutions: L234A, L235E, and G237A.

In some embodiments, an Fc is chosen that has reduced complement fixation. An exemplary Fc, e.g., IgG1 Fc, with reduced complement fixation, has the following two amino acid substitutions: A330S and P331S.

In some embodiments, an Fc is chosen that has essentially no effector function, i.e., it has reduced binding to FcγRs and reduced complement fixation. An exemplary Fc, e.g., IgG1 Fc, that is effectorless, comprises the following five mutations: L234A, L235E, G237A, A330S, and P331S.

When using an IgG4 constant domain, it is usually preferable to include the substitution S228P, which mimics the hinge sequence in IgG1 and thereby stabilizes IgG4 molecules.

Multivalent Antibodies

In one embodiment, the antibodies of the invention may be monovalent or multivalent (e.g., bivalent, trivalent, etc.). As used herein, the term "valency" refers to the number of potential target binding sites associated with an antibody. Each target binding site specifically binds one target molecule or specific position or locus on a target molecule. When an antibody is monovalent, each binding site of the molecule will specifically bind to a single antigen position or epitope. When an antibody comprises more than one target binding site (multivalent), each target binding site may specifically bind the same or different molecules (e.g., may bind to different ligands or different antigens, or different epitopes or positions on the same antigen). See, for example, U.S.P.N. 2009/0130105. In each case, at least one of the binding sites will comprise an epitope, motif or domain associated with a DLL3 isoform.

In one embodiment, the antibodies are bispecific antibodies in which the two chains have different specificities, as described in Millstein et al., 1983, Nature, 305:537-539. Other embodiments include antibodies with additional specificities such as trispecific antibodies. Other more sophisticated compatible multispecific constructs and methods of their fabrication are set forth in U.S.P.N. 2009/0155255, as well as WO 94/04690; Suresh et al., 1986, Methods in Enzymology, 121:210; and WO96/27011.

As stated above, multivalent antibodies may immunospecifically bind to different epitopes of the desired target molecule or may immunospecifically bind to both the target molecule as well as a heterologous epitope, such as a heterologous polypeptide or solid support material. In some embodiments, the multivalent antibodies may include bispecific antibodies or trispecific antibodies. Bispecific antibodies also include cross-linked or "heteroconjugate" antibodies. For example, one of the antibodies in the heteroconjugate can be coupled to avidin, the other to biotin. Such antibodies have, for example, been proposed to target immune system cells to unwanted cells (U.S. Pat. No. 4,676,980), and for treatment of HIV infection (WO 91/00360, WO 92/200373, and EP 03089). Heteroconjugate antibodies may be made using any convenient cross-linking methods. Suitable cross-linking agents are well known in the art and are disclosed in U.S. Pat. No. 4,676,980, along with a number of cross-linking techniques.

In some embodiments, antibody variable domains with the desired binding specificities (antibody-antigen combining sites) are fused to immunoglobulin constant domain sequences, such as an immunoglobulin heavy chain constant domain comprising at least part of the hinge, CH2, and/or CH3 regions, using methods well known to those of ordinary skill in the art.

Antibody Derivatives

An antibody provided herein may be further modified to contain additional nonproteinaceous moieties that are known in the art and readily available. The moieties suitable for derivatization of the antibody include but are not limited to water-soluble polymers.

Non-limiting examples of water-soluble polymers include, but are not limited to, PEG, copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, propropylene glycol homopolymers, polypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight and may be branched or unbranched. The number of polymers attached to the antibody may vary, and if more than one polymer is attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

In another embodiment, conjugates of an antibody and nonproteinaceous moiety that may be selectively heated by exposure to radiation are provided. In one embodiment, the nonproteinaceous moiety is a carbon nanotube (Kam et al., Proc. Natl. Acad. Sci. USA 102: 11600-11605 (2005)). The radiation may be of any wavelength, and includes, but is not limited to, wavelengths that do not harm ordinary cells, but which heat the nonproteinaceous moiety to a temperature at which cells proximal to the antibody-nonproteinaceous moiety are killed.

Another modification of the antibodies described herein is pegylation. An antibody can be pegylated to, for example, increase the biological (e.g., serum) half-life of the antibody. To pegylate an antibody, the antibody, or fragment thereof, typically is reacted with PEG, such as a reactive ester or aldehyde derivative of PEG, under conditions in which one or more PEG groups become attached to the antibody or antibody fragment. Preferably, the pegylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (CI-CIO) alkoxy- or aryloxy-polyethylene glycol or polyethylene glycol-maleimide. In some embodiments, the antibody to be pegylated is an aglycosylated antibody. Methods for pegylating proteins are known in the art and can be applied to the antibodies described herein. See, for example, EP 0 154 316 by Nishimura et al. and EP0401384 by Ishikawa et al.

The present invention also encompasses a human monoclonal antibody described herein conjugated to a therapeutic agent, a polymer, a detectable label or enzyme. In one embodiment, the therapeutic agent is a cytotoxic agent. In one embodiment, the polymer is PEG.

Nucleic Acids, Expression Cassettes, and Vectors

The present invention provides isolated nucleic acid segments that encode the polypeptides, peptide fragments, and coupled proteins of the invention. The nucleic acid segments of the invention also include segments that encode for the same amino acids due to the degeneracy of the genetic code. For example, the amino acid threonine is encoded by ACU, ACC, ACA, and ACG and is therefore degenerate. It is intended that the invention includes all variations of the polynucleotide segments that encode for the same amino acids. Such mutations are known in the art (Watson et al., Molecular Biology of the Gene, Benjamin Cummings 1987). Mutations also include alteration of a nucleic acid segment to encode for conservative amino acid changes, for example, the substitution of leucine for isoleucine and so forth. Such mutations are also known in the art. Thus, the genes and nucleotide sequences of the invention include both the naturally occurring sequences as well as mutant forms.

The nucleic acid segments of the invention may be contained within a vector. A vector may include, but is not limited to, any plasmid, phagemid, F-factor, virus, cosmid, or phage in a double- or single-stranded linear or circular form which may or may not be self transmissible or mobilizable. The vector can also transform a prokaryotic or eukaryotic host either by integration into the cellular genome or exist extra-chromosomally (e.g., autonomous replicating plasmid with an origin of replication).

Preferably the nucleic acid segment in the vector is under the control of, and operably linked to, an appropriate promoter or other regulatory elements for transcription in vitro or in a host cell, such as a eukaryotic cell, or a microbe, e.g., bacteria. The vector may be a shuttle vector that functions in multiple hosts. The vector may also be a cloning vector that typically contains one or a small number of restriction endonuclease recognition sites at which foreign DNA sequences can be inserted in a determinable fashion. Such insertion can occur without loss of essential biological function of the cloning vector. A cloning vector may also contain a marker gene that is suitable for use in the identification and selection of cells transformed with the cloning vector. Examples of marker genes are tetracycline resistance or ampicillin resistance. Many cloning vectors are commercially available (Stratagene, New England Biolabs, Clonetech).

The nucleic acid segments of the invention may also be inserted into an expression vector. Typically an expression vector contains prokaryotic DNA elements coding for a bacterial replication origin and an antibiotic resistance gene to provide for the amplification and selection of the expression vector in a bacterial host; regulatory elements that control initiation of transcription such as a promoter; and DNA elements that control the processing of transcripts such as introns, or a transcription termination/polyadenylation sequence.

Methods to introduce nucleic acid segment into a vector are available in the art (Sambrook et al., Molecular Cloning: A Laboratory Manual, 3rd edition, Cold Spring Harbor Press, Cold Spring Harbor, N.Y. (2001)). Briefly, a vector into which a nucleic acid segment is to be inserted is treated with one or more restriction enzymes (restriction endonuclease) to produce a linearized vector having a blunt end, a "sticky" end with a 5' or a 3' overhang, or any combination of the above. The vector may also be treated with a restriction enzyme and subsequently treated with another modifying enzyme, such as a polymerase, an exonuclease, a phosphatase or a kinase, to create a linearized vector that has characteristics useful for ligation of a nucleic acid segment into the vector. The nucleic acid segment that is to be inserted into the vector is treated with one or more restriction enzymes to create a linearized segment having a blunt end, a "sticky" end with a 5' or a 3' overhang, or any combination of the above. The nucleic acid segment may also be treated with a restriction enzyme and subsequently treated with another DNA modifying enzyme. Such DNA modifying enzymes include, but are not limited to, polymerase, exonuclease, phosphatase or a kinase, to create a nucleic acid segment that has characteristics useful for ligation of a nucleic acid segment into the vector.

The treated vector and nucleic acid segment are then ligated together to form a construct containing a nucleic acid segment according to methods available in the art (Sambrook et al., Molecular Cloning: A Laboratory Manual, 3rd edition, Cold Spring Harbor Press, Cold Spring Harbor, N.Y. (2001)). Briefly, the treated nucleic acid fragment, and the treated vector are combined in the presence of a suitable buffer and ligase. The mixture is then incubated under appropriate conditions to allow the ligase to ligate the nucleic acid fragment into the vector.

The invention also provides an expression cassette which contains a nucleic acid sequence capable of directing expression of a particular nucleic acid segment of the invention, either in vitro or in a host cell. Also, a nucleic acid segment of the invention may be inserted into the expression cassette such that an anti-sense message is produced. The expression cassette is an isolatable unit such that the expression cassette may be in linear form and functional for in vitro transcription and translation assays. The materials and procedures to conduct these assays are commercially available from Promega Corp. (Madison, Wis.). For example, an in vitro transcript may be produced by placing a nucleic acid sequence under the control of a T7 promoter and then using T7 RNA polymerase to produce an in vitro transcript. This transcript may then be translated in vitro through use of a rabbit reticulocyte lysate. Alternatively, the expression cassette can be incorporated into a vector allowing for replication and amplification of the expression cassette within a host cell or also in vitro transcription and translation of a nucleic acid segment.

Such an expression cassette may contain one or a plurality of restriction sites allowing for placement of the nucleic acid segment under the regulation of a regulatory sequence. The expression cassette can also contain a termination signal operably linked to the nucleic acid segment as well as regulatory sequences required for proper translation of the nucleic acid segment. The expression cassette containing the nucleic acid segment may be chimeric, meaning that at least one of its components is heterologous with respect to at least one of its other components. The expression cassette may also be one that is naturally occurring but has been obtained in a recombinant form useful for heterologous expression. Expression of the nucleic acid segment in the expression cassette may be under the control of a constitutive promoter or an inducible promoter, which initiates transcription only when the host cell is exposed to some particular external stimulus.

The expression cassette may include in the 5'-3' direction of transcription, a transcriptional and translational initiation region, a nucleic acid segment and a transcriptional and translational termination region functional in vivo and/or in vitro. The termination region may be native with the transcriptional initiation region, may be native with the nucleic acid segment, or may be derived from another source.

The regulatory sequence can be a polynucleotide sequence located upstream (5' non-coding sequences), within, or downstream (3' non-coding sequences) of a coding sequence, and which influences the transcription, RNA processing or stability, or translation of the associated coding sequence. Regulatory sequences can include, but are not limited to, enhancers, promoters, repressor binding sites, translation leader sequences, introns, and polyadenylation signal sequences. They may include natural and synthetic sequences as well as sequences, which may be a combination of synthetic and natural sequences. While regulatory sequences are not limited to promoters, some useful regulatory sequences include constitutive promoters, inducible promoters, regulated promoters, tissue-specific promoters, viral promoters, and synthetic promoters.

A promoter is a nucleotide sequence that controls the expression of the coding sequence by providing the recognition for RNA polymerase and other factors required for proper transcription. A promoter includes a minimal promoter, consisting only of all basal elements needed for transcription initiation, such as a TATA-box and/or initiator that is a short DNA sequence comprised of a TATA-box and other sequences that serve to specify the site of transcription initiation, to which regulatory elements are added for control of expression. A promoter may be derived entirely from a native gene, or be composed of different elements derived from different promoters found in nature, or even be comprised of synthetic DNA segments. A promoter may contain DNA sequences that are involved in the binding of protein factors that control the effectiveness of transcription initiation in response to physiological or developmental conditions.

The invention also provides a construct containing a vector and an expression cassette. The vector may be selected from, but not limited to, any vector previously described. Into this vector may be inserted an expression cassette through methods known in the art and previously described (Sambrook et al., Molecular Cloning: A Laboratory Manual, 3rd edition, Cold Spring Harbor Press, Cold Spring Harbor, N.Y. (2001)). In one embodiment, the regulatory sequences of the expression cassette may be derived from a source other than the vector into which the expression cassette is inserted. In another embodiment, a construct containing a vector and an expression cassette is formed upon insertion of a nucleic acid segment of the invention into a vector that itself contains regulatory sequences. Thus, an expression cassette is formed upon insertion of the nucleic acid segment into the vector. Vectors containing regulatory sequences are available commercially, and methods for their use are known in the art (Clonetech, Promega, Stratagene).

In another aspect, this disclosure also provides (i) a nucleic acid molecule encoding a polypeptide chain of the antibody or antigen-binding fragment thereof described above; (ii) a vector comprising the nucleic acid molecule as described; and (iii) a cultured host cell comprising the vector as described. Also provided is a method for producing a polypeptide, comprising: (a) obtaining the cultured host cell as described; (b) culturing the cultured host cell in a medium under conditions permitting expression of a polypeptide encoded by the vector and assembling of an antibody or fragment thereof; and (c) purifying the antibody or fragment from the cultured cell or the medium of the cell.

Methods of Production

Antibodies may be produced using recombinant methods and compositions, e.g., as described in U.S. Pat. No. 4,816,567. In one embodiment, an isolated nucleic acid encoding an antibody described herein is provided. Such nucleic acid may encode an amino acid sequence comprising the VL and/or an amino acid sequence comprising the VH of the antibody (e.g., the light and/or heavy chains of the antibody). In a further embodiment, one or more vectors (e.g., expression vectors) comprising such nucleic acid are provided. In a further embodiment, a host cell comprising such nucleic acid is provided. In one such embodiment, a host cell comprises (e.g., has been transformed with): (1) a vector comprising a nucleic acid that encodes an amino acid sequence comprising the VL of the antibody and an amino acid sequence comprising the VH of the antibody, or (2) a first vector comprising a nucleic acid that encodes an amino acid sequence comprising the VL of the antibody and a second vector comprising a nucleic acid that encodes an amino acid sequence comprising the VH of the antibody. In one embodiment, the host cell is eukaryotic, e.g., a Chinese Hamster Ovary (CHO) cell or lymphoid cell (e.g., Y0, NS0, Sp20 cell). In one embodiment, a method of making an antibody is provided, wherein the method comprises culturing a host cell comprising a nucleic acid encoding the antibody, as provided above, under conditions suitable for expression of the antibody, and optionally recovering the antibody from the host cell (or host cell culture medium).

For recombinant production of an antibody, a nucleic acid encoding an antibody, e.g., as described above, is isolated and inserted into one or more vectors for further cloning and/or expression in a host cell. Such nucleic acid may be readily isolated and sequenced using conventional procedures (e.g., by using oligonucleotide probes that are capable of binding specifically to genes encoding the heavy and light chains of the antibody).

Suitable host cells for cloning or expression of antibody-encoding vectors include prokaryotic or eukaryotic cells described herein. For example, antibodies may be produced in bacteria, in particular when glycosylation and Fc effector function are not needed. For expression of antibody fragments and polypeptides in bacteria, see, e.g., U.S. Pat. Nos. 5,648,237, 5,789,199, and 5,840,523. (See also Charlton, Methods in Molecular Biology, Vol. 248 (B. K. C. Lo, ed., Humana Press, Totowa, N.J., 2003), pp. 245-254, describing expression of antibody fragments in *E. coli.*) After expression, the antibody may be isolated from the bacterial cell paste in a soluble fraction and can be further purified.

In addition to prokaryotes, eukaryotic microbes such as filamentous fungi or yeast are suitable cloning or expression hosts for antibody-encoding vectors, including fungi and yeast strains whose glycosylation pathways have been "humanized," resulting in the production of an antibody with a partially or fully human glycosylation pattern. See Gerngross, Nat. Biotech. 22:1409-1414 (2004), and Li et al., Nat. Biotech. 24:210-215 (2006).

Suitable host cells for the expression of glycosylated antibody are also derived from multicellular organisms (invertebrates and vertebrates). Examples of invertebrate cells include plant and insect cells. Numerous baculoviral strains have been identified, which may be used in conjunction with insect cells, particularly for transfection of *Spodoptera frugiperda* cells.

Plant cell cultures can also be utilized as hosts. See, e.g., U.S. Pat. Nos. 5,959,177, 6,040,498, 6,420,548, 7,125,978, and 6,417,429 (describing PLANTIBODIES technology for producing antibodies in transgenic plants).

Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al., J. Gen Virol. 36:59 (1977)); baby hamster kidney cells (BHK); mouse sertoli cells (TM4 cells as described, e.g., in Mather, Biol. Reprod. 23:243-251 (1980)); monkey kidney cells (CV1); African green monkey kidney cells (VERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TRI cells, as described, e.g., in Mather et al., Annals N.Y. Acad. Sci. 383:44-68 (1982); MRC 5 cells; and FS4 cells. Other useful mammalian host cell lines include CHO cells, including DHFR-CHO cells (Urlaub et al., Proc. Natl. Acad. Sci. USA 77:4216 (1980)); and myeloma cell lines such as Y0, NS0, and Sp2/0. For a review of certain mammalian host cell lines suitable for antibody production, see, e.g., Yazaki and Wu, Methods in Molecular Biology, Vol. 248 (B. K. C. Lo, ed., Humana Press, Totowa, N.J.), pp. 255-268 (2003).

COMPOSITIONS AND FORMULATIONS

The antibodies of this invention represent an excellent way for the development of antiviral therapies either alone or in antibody cocktails with additional anti-SARS-CoV-2 virus antibodies for the treatment of human SARS-CoV-2 infections in humans.

In another aspect, the present invention provides a pharmaceutical composition comprising the antibodies of the present invention described herein formulated together with a pharmaceutically acceptable carrier. The composition may optionally contain one or more additional pharmaceutically active ingredients, such as another antibody or a therapeutic agent.

In some embodiments, the pharmaceutical comprises two or more of the antibody or antigen-binding fragment thereof described above, such as any combinations of the antibody or antigen-binding fragment thereof comprising a heavy chain and a light chain that comprise the respective amino acid sequences described herein.

The pharmaceutical compositions of the invention also can be administered in a combination therapy with, for example, another immune-stimulatory agent, an antiviral agent, or a vaccine, etc. In some embodiments, a composition comprises an antibody of this invention at a concentration of at least 1 mg/ml, 5 mg/ml, 10 mg/ml, 50 mg/ml, 100 mg/ml, 150 mg/ml, 200 mg/ml, 1-300 mg/ml, or 100-300 mg/ml.

In some embodiments, the second therapeutic agent comprises an anti-inflammatory drug or an antiviral compound. In some embodiments, the antiviral compound comprises: a nucleoside analog, a peptoid, an oligopeptide, a polypeptide, a protease inhibitor, a 3C-like protease inhibitor, a papain-like protease inhibitor, or an inhibitor of an RNA dependent RNA polymerase. In some embodiments, the antiviral compound may include: acyclovir, gancyclovir, vidarabine, foscarnet, cidofovir, amantadine, ribavirin, trifluorothymidine, zidovudine, didanosine, zalcitabine or an interferon. In some embodiments, the interferon is an interferon-α or an interferon-β.

Also within the scope of this disclosure is use of the pharmaceutical composition in the preparation of a medicament for the diagnosis, prophylaxis, treatment, or combination thereof of a condition resulting from a SARS-CoV-2.

The pharmaceutical composition can comprise any number of excipients. Excipients that can be used include carriers, surface-active agents, thickening or emulsifying agents, solid binders, dispersion or suspension aids, solubilizers, colorants, flavoring agents, coatings, disintegrating agents, lubricants, sweeteners, preservatives, isotonic agents, and combinations thereof. The selection and use of suitable excipients is taught in Gennaro, ed., Remington: The Science and Practice of Pharmacy, 20th Ed. (Lippincott Williams & Wilkins 2003), the disclosure of which is incorporated herein by reference.

Preferably, a pharmaceutical composition is suitable for intravenous, intramuscular, subcutaneous, parenteral, spinal or epidermal administration (e.g., by injection or infusion). Depending on the route of administration, the active compound can be coated in a material to protect it from the action of acids and other natural conditions that may inactivate it. The phrase "parenteral administration" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion. Alternatively, an antibody of the present invention described herein can be administered via a non-parenteral route, such as a topical, epidermal or mucosal route of administration, e.g., intranasally, orally, vaginally, rectally, sublingually or topically.

The pharmaceutical compositions of the invention may be prepared in many forms that include tablets, hard or soft gelatin capsules, aqueous solutions, suspensions, and liposomes and other slow-release formulations, such as shaped polymeric gels. An oral dosage form may be formulated such that the antibody is released into the intestine after passing through the stomach. Such formulations are described in U.S. Pat. No. 6,306,434 and in the references contained therein.

Oral liquid pharmaceutical compositions may be in the form of, for example, aqueous or oily suspensions, solutions, emulsions, syrups or elixirs, or may be presented as a dry product for constitution with water or other suitable vehicle before use. Such liquid pharmaceutical compositions may contain conventional additives such as suspending agents, emulsifying agents, non-aqueous vehicles (which may include edible oils), or preservatives.

An antibody can be formulated for parenteral administration (e.g., by injection, for example, bolus injection or continuous infusion) and may be presented in unit dosage form in ampules, prefilled syringes, small volume infusion containers or multi-dose containers with an added preservative. The pharmaceutical compositions may take such forms as suspensions, solutions, or emulsions in oily or aqueous vehicles, and may contain formulatory agents such as suspending, stabilizing and/or dispersing agents. Pharmaceutical compositions suitable for rectal administration can be prepared as unit dose suppositories. Suitable carriers include saline solution and other materials commonly used in the art.

For administration by inhalation, an antibody can be conveniently delivered from an insufflator, nebulizer or a pressurized pack or other convenient means of delivering an aerosol spray. Pressurized packs may comprise a suitable propellant such as dichlorodifluoromethane, trichlorofluoromethane, dichlorotetrafluoroethane, carbon dioxide or other suitable gas. In the case of a pressurized aerosol, the dosage unit may be determined by providing a valve to deliver a metered amount.

Alternatively, for administration by inhalation or insufflation, an antibody may take the form of a dry powder composition, for example, a powder mix of a modulator and a suitable powder base such as lactose or starch. The powder composition may be presented in unit dosage form in, for example, capsules or cartridges or, e.g., gelatin or blister packs from which the powder may be administered with the aid of an inhalator or insufflator. For intra-nasal administration, an antibody may be administered via a liquid spray, such as via a plastic bottle atomizer.

Pharmaceutical compositions of the invention may also contain other ingredients such as flavorings, colorings, antimicrobial agents, or preservatives. It will be appreciated that the amount of an antibody required for use in treatment will vary not only with the particular carrier selected but also with the route of administration, the nature of the condition being treated and the age and condition of the patient. Ultimately the attendant health care provider may determine proper dosage. In addition, a pharmaceutical composition may be formulated as a single unit dosage form.

The pharmaceutical composition of the present invention can be in the form of sterile aqueous solutions or dispersions. It can also be formulated in a microemulsion, liposome, or other ordered structure suitable to high drug concentration.

An antibody of the present invention described herein can be administered as a sustained release formulation, in which case less frequent administration is required. Dosage and frequency vary depending on the half-life of the antibody in the patient. In general, human antibodies show the longest half-life, followed by humanized antibodies, chimeric antibodies, and nonhuman antibodies. The dosage and frequency of administration can vary depending on whether the treatment is prophylactic or therapeutic. In prophylactic applications, a relatively low dosage is administered at relatively infrequent intervals over a long period of time. Some patients continue to receive treatment for the rest of their lives. In therapeutic applications, a relatively high dosage at relatively short intervals is sometimes required until progression of the disease is reduced or terminated, and preferably, until the patient shows partial or complete amelioration of symptoms of disease. Thereafter, the patient can be administered a prophylactic regime.

The amount of active ingredient that can be combined with a carrier material to produce a single dosage form will vary depending upon the subject being treated and the particular mode of administration and will generally be that amount of the composition, which produces a therapeutic effect. Generally, out of one hundred percent, this amount will range from about 0.01% to about 99% of active ingredient, preferably from about 0.1% to about 70%, most preferably from about 1% to about 30% of active ingredient in combination with a pharmaceutically acceptable carrier.

Dosage regimens can be adjusted to provide the optimum desired response (e.g., a therapeutic response). For example, a single bolus can be administered, several divided doses can be administered over time or the dose can be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. Alternatively, the antibody can be administered as a sustained release formulation, in which case less frequent administration is required. For administration of the antibody, the dosage ranges from about 0.0001 to 800 mg/kg, and more usually 0.01 to 5 mg/kg, of the host body weight. For example dosages can be 0.3 mg/kg body weight, 1 mg/kg body weight, 3 mg/kg body weight, 5 mg/kg body weight or 10 mg/kg body weight or within the range of 1-10 mg/kg. An exemplary treatment regime entails administration once per week, once every two weeks, once every three weeks, once every four weeks, once a month, once every 3 months or once every three to 6 months. Preferred dosage regimens for an antibody of the invention include 1 mg/kg body weight or 3 mg/kg body weight via intravenous administration, with the antibody being given using one of the following dosing schedules: (i) every four weeks for six dosages, then every three months; (ii) every three weeks; (iii) 3 mg/kg body weight once followed by 1 mg/kg body weight every three weeks. In some methods, dosage is adjusted to achieve a plasma antibody concentration of about 1-1000 μg/ml and in some methods about 25-300 μg/ml. A "therapeutically effective dosage" of an antibody of the invention preferably results in a decrease in severity of disease symptoms, an increase in frequency and duration of disease symptom-free periods, or a prevention of impairment or disability due to the disease affliction. For example, for the treatment of SARS-CoV-2 infection in a subject, a "therapeutically effective dosage" preferably inhibits SARS-CoV-2 virus replication or uptake by host cells by at least about 20%, more preferably by at least about 40%, even more preferably by at least about 60%, and still more preferably by at least about 80% relative to untreated subjects. A therapeutically effective amount of a therapeutic compound can neutralize SARS-CoV-2 virus, or otherwise ameliorate symptoms in a subject, which is typically a human or can be another mammal.

The pharmaceutical composition can be a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. See, e.g., Sustained and Controlled Release Drug Delivery Systems, J. R. Robinson, ed., Marcel Dekker, Inc., New York, 1978.

Therapeutic compositions can be administered via medical devices such as (1) needleless hypodermic injection devices (e.g., U.S. Pat. Nos. 5,399,163; 5,383,851; 5,312,335; 5,064,413; 4,941,880; 4,790,824; and 4,596,556); (2) micro-infusion pumps (U.S. Pat. No. 4,487,603); (3) transdermal devices (U.S. Pat. No. 4,486,194); (4) infusion apparati (U.S. Pat. Nos. 4,447,233 and 4,447,224); and (5) osmotic devices (U.S. Pat. Nos. 4,439,196 and 4,475,196); the disclosures of which are incorporated herein by reference.

In some embodiments, the human monoclonal antibodies of the invention described herein can be formulated to ensure proper distribution in vivo. For example, to ensure that the therapeutic compounds of the invention cross the blood-brain barrier, they can be formulated in liposomes, which may additionally comprise targeting moieties to enhance selective transport to specific cells or organs. See, e.g., U.S. Pat. Nos. 4,522,811; 5,374,548; 5,416,016; and 5,399,331; V. V. Ranade (1989) Clin. Pharmacol. 29:685; Umezawa et al., (1988) Biochem. Biophys. Res. Commun. 153:1038; Bloeman et al. (1995) FEBS Lett. 357:140; M. Owais et al. (1995) Antimicrob. Agents Chemother. 39:180; Briscoe et al. (1995) Am. Physiol. 1233:134; Schreier et al. (1994). Biol. Chem. 269:9090; Keinanen and Laukkanen (1994) FEBS Lett. 346:123; and Killion and Fidler (1994) Immunomethods 4:273.

In some embodiments, the initial dose may be followed by administration of a second or a plurality of subsequent doses of the antibody or antigen-binding fragment thereof in an amount that can be approximately the same or less than that of the initial dose, wherein the subsequent doses are separated by at least 1 day to 3 days; at least one week, at least 2 weeks; at least 3 weeks; at least 4 weeks; at least 5 weeks; at least 6 weeks; at least 7 weeks; at least 8 weeks; at least 9 weeks; at least 10 weeks; at least 12 weeks; or at least 14 weeks.

Various delivery systems are known and can be used to administer the pharmaceutical composition of the invention, e.g., encapsulation in liposomes, microparticles, microcapsules, recombinant cells capable of expressing the mutant viruses, receptor-mediated endocytosis (see, e.g., Wu et al. (1987) J. Biol. Chem. 262:4429-4432). Methods of introduction include, but are not limited to, intradermal, transdermal, intramuscular, intraperitoneal, intravenous, subcutaneous, intranasal, epidural, and oral routes. The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. The pharmaceutical composition can also be delivered in a vesicle, in particular, a liposome (see, for example, Langer (1990) Science 249:1527-1533).

The use of nanoparticles to deliver the antibodies of the present invention is also contemplated herein. Antibody-conjugated nanoparticles may be used both for therapeutic and diagnostic applications. Antibody-conjugated nanoparticles and methods of preparation and use are described in detail by Arruebo, M., et al. 2009 ("Antibody-conjugated nanoparticles for biomedical applications" in J. Nanomat. Volume 2009, Article ID 439389), incorporated herein by reference. Nanoparticles may be developed and conjugated to antibodies contained in pharmaceutical compositions to target cells. Nanoparticles for drug delivery have also been described in, for example, U.S. Pat. No. 8,257,740, or U.S. Pat. No. 8,246,995, each incorporated herein in its entirety.

In certain situations, the pharmaceutical composition can be delivered in a controlled release system. In one embodiment, a pump may be used. In another embodiment, polymeric materials can be used. In yet another embodiment, a controlled release system can be placed in proximity of the composition's target, thus requiring only a fraction of the systemic dose.

The injectable preparations may include dosage forms for intravenous, subcutaneous, intracutaneous, intracranial, intraperitoneal and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUIIVIALOG™ pen, HUMALIN 70/30™ pen (Eli Lilly and Co., Indianapolis, Ind.), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPEN™, OPTIPEN PRO™, OPTIPEN STARLET™, and OPTICLIK™ (Sanofi-Aventis, Frankfurt, Germany), to name only a few. Examples of disposable pen delivery devices having applications in subcutaneous delivery of a pharmaceutical composition of the present invention include, but certainly are not limited to the SOLOSTAR™ pen (Sanofi-Aventis), the FLEXPEN™ (Novo Nordisk), and the KWIKPEN™ (Eli Lilly), the SURECLICK™ Autoinjector (Amgen, Thousand Oaks, CA), the PENLET™ (Haselmeier, Stuttgart, Germany), the EPIPEN (Dey, L. P.) and the HUIIVIIRA™ Pen (Abbott Labs, Abbott Park, IL), to name only a few.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the antibody contained is generally about 5 to about 500 mg per dosage form in a unit dose; especially in the form of injection, it is preferred that the antibody is contained in about 5 to about 300 mg and in about 10 to about 300 mg for the other dosage forms.

Methods and Uses

Methods of Treatment

The antibodies, compositions, and formulations described herein can be used to neutralize SARS-CoV-2 virus and thereby treating or preventing SARS-CoV-2 infections.

Accordingly, in one aspect, this disclosure further provides a method of neutralizing SARS-CoV-2 in a subject, comprising administering to a subject in need thereof a therapeutically effective amount of the antibody or antigen-binding fragment thereof or a therapeutically effective amount of the pharmaceutical composition, as described above.

In another aspect, this disclosure additionally provides a method of preventing or treating a SARS-CoV-2 infection, comprising administering to a subject in need thereof a therapeutically effective amount of the antibody or antigen-binding fragment thereof or a therapeutically effective amount of the pharmaceutical composition, as described above.

The neutralizing of the SARS-CoV-2 virus can be done via (i) inhibiting SARS-CoV-2 virus binding to a target cell; (ii) inhibiting SARS-CoV-2 virus uptake by a target cell; (iii) inhibiting SARS-CoV-2 virus replication; and (iv) inhibiting SARS-CoV-2 virus particles release from infected cells. One skilled in the art possesses the ability to perform any assay to assess neutralization of SARS-CoV-2 virus.

Notably, the neutralizing properties of antibodies may be assessed by a variety of tests, which all may assess the consequences of (i) inhibition of SARS-CoV-2 virus binding to a target cell; (ii) inhibition of SARS-CoV-2 virus uptake by a target cell; (iii) inhibition of SARS-CoV-2 virus replication; and (iv) inhibition of SARS-CoV-2 virus particles release from infected cells. In other words, implementing different tests may lead to the observation of the same consequence, i.e., the loss of infectivity of the SARS-CoV-2 virus. Thus, in one embodiment, the present invention provides a method of neutralizing SARS-CoV-2 virus in a subject comprising administering to the subject a therapeutically effective amount of the antibody of the present invention described herein.

Another aspect of the present invention provides a method of treating a SARS-CoV-2-related disease. Such a method includes therapeutic (following SARS-CoV-2 infection) and prophylactic (prior to SARS-CoV-2 exposure, infection or pathology). For example, therapeutic and prophylactic methods of treating an individual for a SARS-CoV-2 infection include treatment of an individual having or at risk of having a SARS-CoV-2 infection or pathology, treating an individual with a SARS-CoV-2 infection, and methods of protecting an individual from a SARS-CoV-2 infection, to decrease or reduce the probability of a SARS-CoV-2 infection in an individual, to decrease or reduce susceptibility of an individual to a SARS-CoV-2 infection, or to inhibit or prevent a SARS-CoV-2 infection in an individual, and to decrease, reduce, inhibit or suppress transmission of a SARS-CoV-2 from an infected individual to an uninfected individual. Such methods include administering an antibody of the present invention or a composition comprising the antibody disclosed herein to therapeutically or prophylactically treat (vaccinate or immunize) an individual having or at risk of having a SARS-CoV-2 infection or pathology. Accordingly, methods can treat the SARS-CoV-2 infection or pathology, or provide the individual with protection from infection (e.g., prophylactic protection).

In one embodiment, a method of treating a SARS-CoV-2-related disease comprises administering to an individual in need thereof an antibody or therapeutic composition disclosed herein in an amount sufficient to reduce one or more physiological conditions or symptoms associated with a SARS-CoV-2 infection or pathology, thereby treating the SARS-CoV-2-related disease.

In one embodiment, an antibody or therapeutic composition disclosed herein is used to treat a SARS-CoV-2-related disease. Use of an antibody or therapeutic composition disclosed herein treats a SARS-CoV-2-related disease by reducing one or more physiological conditions or symptoms associated with a SARS-CoV-2 infection or pathology. In aspects of this embodiment, administration of an antibody or therapeutic composition disclosed herein is in an amount sufficient to reduce one or more physiological conditions or symptoms associated with a SARS-CoV-2 infection or pathology, thereby treating the SARS-CoV-2-based disease. In other aspects of this embodiment, administration of an antibody or therapeutic composition disclosed herein is in an amount sufficient to increase, induce, enhance, augment, promote or stimulate SARS-CoV-2 clearance or removal; or decrease, reduce, inhibit, suppress, prevent, control, or limit transmission of SARS-CoV-2 to another individual.

One or more physiological conditions or symptoms associated with a SARS-CoV-2 infection or pathology will respond to a method of treatment disclosed herein. The symptoms of SARS-CoV-2 infection or pathology vary, depending on the phase of infection.

In some embodiments, the method of neutralizing SARS-CoV-2 in a subject comprises administering to a subject in need thereof a therapeutically effective amount of a first antibody or antigen-binding fragment thereof and a second antibody or antigen-binding fragment thereof of the antibody or antigen-binding fragment, as described above, wherein the first antibody or antigen-binding fragment thereof and the second antibody or antigen binding fragment thereof exhibit synergistic activity or a therapeutically effective amount of the pharmaceutical composition described above.

In some embodiments, the method of preventing or treating a SARS-CoV-2 infection, comprising administering to a subject in need thereof a therapeutically effective amount of a first antibody or antigen-binding fragment thereof and a second antibody or antigen-binding fragment thereof of the antibody or antigen-binding fragment, as described above, wherein the first antibody or antigen-binding fragment thereof and the second antibody or antigen binding fragment thereof exhibit synergistic activity or a therapeutically effective amount of the pharmaceutical composition described above. In some embodiments, the first antibody or antigen-binding fragment thereof is administered before, after, or concurrently with the second antibody or antigen-binding fragment thereof.

In some embodiments, the first antibody or antigen-binding fragment thereof and the second antibody or antigen-binding fragment thereof can be any combinations of the antibody or antigen-binding fragment thereof comprising a heavy chain and a light chain that comprise the respective amino acid sequences described herein.

In some embodiments, the second therapeutic agent comprises an anti-inflammatory drug or an antiviral compound. In some embodiments, the antiviral compound comprises: a nucleoside analog, a peptoid, an oligopeptide, a polypeptide, a protease inhibitor, a 3C-like protease inhibitor, a papain-like protease inhibitor, or an inhibitor of an RNA dependent RNA polymerase. In some embodiments, the antiviral compound may include: acyclovir, gancyclovir, vidarabine, foscarnet, cidofovir, amantadine, ribavirin, trifluorothymidine, zidovudine, didanosine, zalcitabine or an interferon. In some embodiments, the interferon is an interferon-α or an interferon-β.

In some embodiments, the antibody or antigen-binding fragment thereof is administered before, after, or concurrently with the second therapeutic agent or therapy. In some embodiments, the antibody or antigen-binding fragment thereof is administered to the subject intravenously, subcutaneously, or intraperitoneally. In some embodiments, the antibody or antigen-binding fragment thereof is administered prophylactically or therapeutically.

The antibodies described herein can be used together with one or more of other anti-SARS-CoV-2 virus antibodies to neutralize SARS-CoV-2 virus and thereby treating SARS-CoV-2 infections.

Combination Therapies

Combination therapies may include an anti-SARS-CoV-2 antibody of the invention and any additional therapeutic agent that may be advantageously combined with an antibody of the invention or with a biologically active fragment of an antibody of the invention. The antibodies of the present invention may be combined synergistically with one or more drugs or therapy used to treat a disease or disorder associated with a viral infection, such as a SARS-CoV-2 infection. In some embodiments, the antibodies of the invention may be combined with a second therapeutic agent to ameliorate one or more symptoms of said disease. In some embodiments, the antibodies of the invention may be combined with a second antibody to provide synergistic activity in ameliorating one or more symptoms of said disease. In some embodiments, the first antibody or antigen-binding fragment thereof is administered before, after, or concurrently with the second antibody or antigen-binding fragment thereof.

For example, the antibody described herein can be used in various detection methods for use in, e.g., monitoring the progression of a SARS-CoV-2 infection; monitoring patient response to treatment for such an infection, etc. The present disclosure provides methods of detecting a neuraminidase polypeptide in a biological sample obtained from an individual. The methods generally involve: a) contacting the biological sample with a subject anti-neuraminidase antibody; and b) detecting binding, if any, of the antibody to an epitope present in the sample. In some instances, the antibody comprises a detectable label. The level of neuraminidase polypeptide detected in the biological sample can provide an indication of the stage, degree, or severity of a SARS-CoV-2 infection. The level of the neuraminidase polypeptide detected in the biological sample can provide an indication of the individual's response to treatment for a SARS-CoV-2 infection.

In some embodiments, the second therapeutic agent is another antibody to a SARS-COV-2 protein or a fragment thereof. It is contemplated herein to use a combination ("cocktail") of antibodies with broad neutralization or inhibitory activity against SARS-COV-2. In some embodiments, non-competing antibodies may be combined and administered to a subject in need thereof. In some embodiments, the antibodies comprising the combination bind to distinct non-overlapping epitopes on the protein. In some embodiments, the second antibody may possess longer half-life in human serum.

As used herein, the term "in combination with" means that additional therapeutically active component(s) may be administered prior to, concurrent with, or after the administration of the anti-SARS-COV-2 antibody of the present invention. The term "in combination with" also includes sequential or concomitant administration of an anti-SARS-COV-2 antibody and a second therapeutic agent.

The additional therapeutically active component(s) may be administered to a subject prior to administration of an anti-SARS-COV-2 antibody of the present invention. For example, a first component may be deemed to be administered "prior to" a second component if the first component is administered 1 week before, 72 hours before, 60 hours before, 48 hours before, 36 hours before, 24 hours before, 12 hours before, 6 hours before, 5 hours before, 4 hours before, 3 hours before, 2 hours before, 1 hour before, 30 minutes before, 15 minutes before, 10 minutes before, 5 minutes before, or less than 1 minute before administration of the second component. In other embodiments, the additional therapeutically active component(s) may be administered to a subject after administration of an anti-SARS-COV-2 antibody of the present invention. For example, a first component may be deemed to be administered "after" a second component if the first component is administered 1 minute after, 5 minutes after, 10 minutes after, 15 minutes after, 30 minutes after, 1 hour after, 2 hours after, 3 hours after, 4 hours after, 5 hours after, 6 hours after, 12 hours after, 24 hours after, 36 hours after, 48 hours after, 60 hours after, 72 hours after administration of the second component. In yet other embodiments, the additional therapeutically active component(s) may be administered to a subject concurrent with administration of an anti-SARS-COV-2 antibody of the present invention. "Concurrent" administration, for purposes of the present invention, includes, e.g., administration of an anti-SARS-COV-2 antibody and an additional therapeutically active component to a subject in a single dosage form, or in separate dosage forms administered to the subject within about 30 minutes or less of each other. If administered in separate dosage forms, each dosage form may be administered via the same route (e.g., both the anti-SARS-COV-2 antibody and the additional therapeutically active component may be administered intravenously, etc.); alternatively, each dosage form may be administered via a different route (e.g., the anti-SARS-COV-2 antibody may be administered intravenously, and the additional therapeutically active component may be administered orally). In any event, administering the components in a single dosage from, in separate dosage forms by the same route, or in separate dosage forms by different routes are all considered "concurrent administration," for purposes of the present disclosure. For purposes of the present disclosure, administration of an anti-SARS-COV-2 antibody "prior to," "concurrent with," or "after" (as those terms are defined herein-above) administration of an additional therapeutically active component is considered administration of an anti-SARS-COV-2 antibody "in combination with" an additional therapeutically active component.

The present invention includes pharmaceutical compositions in which an anti-SARS-COV-2 antibody of the present invention is co-formulated with one or more of the additional therapeutically active component(s) as described elsewhere herein.

Administration Regimens

According to certain embodiments, a single dose of an anti-SARS-COV-2 antibody of the invention (or a pharmaceutical composition comprising a combination of an anti-SARS-COV-2 antibody and any of the additional therapeutically active agents mentioned herein) may be administered to a subject in need thereof. According to certain embodiments of the present invention, multiple doses of an anti-SARS-COV-2 antibody (or a pharmaceutical composition comprising a combination of an anti-SARS-COV-2 antibody and any of the additional therapeutically active agents mentioned herein) may be administered to a subject over a defined time course. The methods according to this aspect of the invention comprise sequentially administering to a subject multiple doses of an anti-SARS-COV-2 antibody of the invention. As used herein, "sequentially administering" means that each dose of anti-SARS-COV-2 antibody is administered to the subject at a different point in time, e.g., on different days separated by a predetermined interval (e.g., hours, days, weeks or months). The present invention includes methods which comprise sequentially administering to the patient a single initial dose of an anti-SARS-COV-2 antibody, followed by one or more secondary doses of the anti-SARS-COV-2 antibody, and optionally followed by one or more tertiary doses of the anti-SARS-COV-2 antibody.

The terms "initial dose," "secondary doses," and "tertiary doses," refer to the temporal sequence of administration of the anti-SARS-COV-2 antibody of the invention. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of anti-SARS-COV-2 antibody, but generally may differ from one another in terms of frequency of administration. In some embodiments, however, the amount of anti-SARS-COV-2 antibody contained in the initial, secondary and/or tertiary doses varies from one another (e.g., adjusted up or down as appropriate) during the course of treatment. In some embodiments, two or more (e.g., 2, 3, 4, or 5) doses are administered at the beginning of the treatment regimen as "loading doses" followed by subsequent doses that are administered on a less frequent basis (e.g., "maintenance doses").

In certain exemplary embodiments of the present invention, each secondary and/or tertiary dose is administered 1 to 48 hours (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) after the immediately preceding dose. The phrase "the immediately preceding dose," as used herein, means, in a sequence of multiple administrations, the dose of anti-SARS-COV-2 antibody, which is administered to a patient prior to the administration of the very next dose in the sequence with no intervening doses.

The methods, according to this aspect of the invention, may comprise administering to a patient any number of secondary and/or tertiary doses of an anti-SARS-COV-2 antibody. For example, In some embodiments, only a single secondary dose is administered to the patient. In other embodiments, two or more (e.g., 2, 3, 4, 5, 6, 7, 8, or more) secondary doses are administered to the patient. Likewise, In some embodiments, only a single tertiary dose is administered to the patient. In other embodiments, two or more (e.g., 2, 3, 4, 5, 6, 7, 8, or more) tertiary doses are administered to the patient.

In some embodiments of the invention, the frequency at which the secondary and/or tertiary doses are administered to a patient can vary over the course of the treatment regimen. The frequency of administration may also be adjusted during the course of treatment by a physician depending on the needs of the individual patient following clinical examination.

Diagnostic Uses of the Antibodies

The anti-SARS-COV-2 antibodies of the present invention may be used to detect and/or measure SARS-COV-2 in a sample, e.g., for diagnostic purposes. Some embodiments contemplate the use of one or more antibodies of the present invention in assays to detect a SARS-COV-2-associated-disease or disorder. Exemplary diagnostic assays for SARS-COV-2 may comprise, e.g., contacting a sample, obtained from a patient, with an anti-SARS-COV-2 antibody of the invention, wherein the anti-SARS-COV-2 antibody is labeled with a detectable label or reporter molecule or used as a capture ligand to selectively isolate SARS-COV-2 from patient samples. Alternatively, an unlabeled anti-SARS-COV-2 antibody can be used in diagnostic applications in combination with a secondary antibody, which is itself detectably labeled. The detectable label or reporter molecule can be a radioisotope, such as H, C, P, S, or I; a fluorescent or chemiluminescent moiety such as fluorescein isothiocyanate, or rhodamine; or an enzyme such as alkaline phosphatase, β-galactosidase, horseradish peroxidase, or luciferase. Specific exemplary assays that can be used to detect or measure SARS-COV-2 in a sample include enzyme-linked immunosorbent assay (ELISA), radioimmunoassay (MA), and fluorescence-activated cell sorting (FACS).

In another aspect, this disclosure further provides a method for detecting the presence of SARS CoV-2 in a sample comprising the steps of: (i) contacting a sample with the antibody or antigen-binding fragment thereof described above; and (ii) determining binding of the antibody or antigen-binding fragment to one or more SARS CoV-2 antigens, wherein binding of the antibody to the one or more SARS CoV-2 antigens is indicative of the presence of SARS CoV-2 in the sample.

In some embodiments, the SARS-CoV-2 antigen comprises a S polypeptide, such as a S polypeptide of a human or an animal SARS-CoV-2. In some embodiments, the SARS-CoV-2 antigen comprises the receptor-binding domain (RBD) of the S polypeptide. In some embodiments, the RBD comprises amino acids 319-541 of the S polypeptide.

In some embodiments, the antibody or antigen-binding fragment thereof is conjugated to a label. In some embodiments, the step of detecting comprises contacting a secondary antibody with the antibody or antigen-binding fragment thereof and wherein the secondary antibody comprises a label. In some embodiments, the label includes a fluorescent label, a chemiluminescent label, a radiolabel, and an enzyme.

In some embodiments, the step of detecting comprises detecting fluorescence or chemiluminescence. In some embodiments, the step of detecting comprises a competitive binding assay or ELISA.

In some embodiments, the method further comprises binding the sample to a solid support. In some embodiments, the solid support includes microparticles, microbeads, magnetic beads, and an affinity purification column.

Samples that can be used in SARS-COV-2 diagnostic assays according to the present invention include any tissue or fluid sample obtainable from a patient, which contains detectable quantities of either SARS-COV-2 protein, or fragments thereof, under normal or pathological conditions. Generally, levels of SARS-COV-2 protein in a particular sample obtained from a healthy patient (e.g., a patient not afflicted with a disease associated with SARS-COV-2) will be measured to initially establish a baseline, or standard, level of SARS-COV-2. This baseline level of SARS-COV-2 can then be compared against the levels of SARS-COV-2 measured in samples obtained from individuals suspected of having a SARS-COV-2-associated condition, or symptoms associated with such condition.

The antibodies specific for SARS-COV-2 protein may contain no additional labels or moieties, or they may contain an N-terminal or C-terminal label or moiety. In one embodiment, the label or moiety is biotin. In a binding assay, the location of a label (if any) may determine the orientation of the peptide relative to the surface upon which the peptide is bound. For example, if a surface is coated with avidin, a peptide containing an N-terminal biotin will be oriented such that the C-terminal portion of the peptide will be distal to the surface.

Kits

In another aspect, this disclosure provides a kit comprising a pharmaceutically acceptable dose unit of the antibody or antigen-binding fragment thereof of or the pharmaceutical composition as described above. Also within the scope of this disclosure is a kit for the diagnosis, prognosis or monitoring the treatment of SARS-CoV-2 in a subject, comprising: the antibody or antigen-binding fragment thereof as described; and a least one detection reagent that binds specifically to the antibody or antigen-binding fragment thereof.

In some embodiments, the kit also includes a container that contains the composition and optionally informational material. The informational material can be descriptive, instructional, marketing or other material that relates to the methods described herein and/or the use of the agents for therapeutic benefit. In an embodiment, the kit also includes an additional therapeutic agent, as described above. For example, the kit includes a first container that contains the composition and a second container for the additional therapeutic agent.

The informational material of the kits is not limited in its form. In some embodiments, the informational material can include information about production of the composition, concentration, date of expiration, batch or production site information, and so forth. In one embodiment, the informational material relates to methods of administering the composition, e.g., in a suitable dose, dosage form, or mode of administration (e.g., a dose, dosage form, or mode of administration described herein), to treat a subject in need thereof. In one embodiment, the instructions provide a dosing regimen, dosing schedule, and/or route of administration of the composition or the additional therapeutic agent. The information can be provided in a variety of formats, including printed text, computer-readable material, video recording, or audio recording, or information that contains a link or address to substantive material.

The kit can include one or more containers for the composition. In some embodiments, the kit contains separate containers, dividers or compartments for the composition and informational material. For example, the composition can be contained in a bottle or vial, and the informational material can be contained in a plastic sleeve or packet. In other embodiments, the separate elements of the kit are contained within a single, undivided container. For example, the composition is contained in a bottle or vial that has attached thereto the informational material in the form of a label. In some embodiments, the kit includes a plurality (e.g., a pack) of individual containers, each containing one or more unit dosage forms (e.g., a dosage form described herein) of the agents.

The kit optionally includes a device suitable for administration of the composition or other suitable delivery device. The device can be provided pre-loaded with one or both of the agents or can be empty, but suitable for loading. Such a kit may optionally contain a syringe to allow for injection of the antibody contained within the kit into an animal, such as a human.

Definitions

To aid in understanding the detailed description of the compositions and methods according to the disclosure, a few express definitions are provided to facilitate an unambiguous disclosure of the various aspects of the disclosure. Unless otherwise defined, all technical and scientific terms used herein have the same meaning as commonly understood by one of ordinary skill in the art to which this disclosure belongs.

The term "antibody" as referred to herein includes whole antibodies and any antigen-binding fragment or single chains thereof. Whole antibodies are glycoproteins comprising at least two heavy (H) chains and two light (L) chains inter-connected by disulfide bonds. Each heavy chain is comprised of a heavy chain variable region (abbreviated herein as VH) and a heavy chain constant region. The heavy chain constant region is comprised of three domains, CH1, CH2 and CH3. Each light chain is comprised of a light chain variable region (abbreviated herein as VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. The heavy chain variable region CDRs and FRs are HFR1, HCDR1, HFR2, HCDR2, HFR3, HCDR3, HFR4. The light chain variable region CDRs and FRs are LFR1, LCDR1, LFR2, LCDR2, LFR3, LCDR3, LFR4. The variable regions of the heavy and light chains contain a binding domain that interacts with an antigen. The constant regions of the antibodies can mediate the binding of the immunoglobulin to host tissues or factors, including various cells of the immune system (e.g., effector cells) and the first component (CIq) of the classical complement system.

The term "antigen-binding fragment or portion" of an antibody (or simply "antibody fragment or portion"), as used herein, refers to one or more fragments of an antibody that retain the ability to specifically bind to an antigen (e.g., a Spike or S protein of SARS-CoV-2 virus). It has been shown that the antigen-binding function of an antibody can be performed by fragments of a full-length antibody. Examples of binding fragments encompassed within the term "antigen-binding fragment or portion" of an antibody include (i) a Fab fragment, a monovalent fragment consisting of the VL, VH, CL, and CHI domains; (ii) a F(ab')2 fragment, a bivalent fragment comprising two Fab fragments linked by a disulfide bridge at the hinge region; (iii) a Fab' fragment, which is essentially a Fab with part of the hinge region (see, FUNDAMENTAL IMMUNOLOGY (Paul ed., 3rd ed. 1993)); (iv) a Fd fragment consisting of the VH and CHI domains; (v) a Fv fragment consisting of the VL and VH domains of a single arm of an antibody, (vi) a dAb fragment (Ward et al., (1989) Nature 341:544-546), which consists of a VH domain; (vii) an isolated CDR; and (viii) a nanobody, a heavy chain variable region containing a single variable domain and two constant domains. Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv or scFv); see, e.g., Bird et al. (1988) Science 242:423-426; and Huston et al. (1988) Proc. Natl. Acad. Sci. USA 85:5879-5883). Such single chain antibodies are also intended to be encompassed within the term "antigen-binding fragment or portion" of an antibody. These antibody fragments are obtained using conventional techniques known to those with skill in the art, and the fragments are screened for utility in the same manner as are intact antibodies.

An "isolated antibody," as used herein, is intended to refer to an antibody that is substantially free of other antibodies having different antigenic specificities (e.g., an isolated antibody that specifically binds to a Spike or S protein of SARS-CoV-2 virus is substantially free of antibodies that specifically bind antigens other than the neuraminidase). An isolated antibody can be substantially free of other cellular material and/or chemicals.

The terms "monoclonal antibody" or "monoclonal antibody composition" as used herein refer to a preparation of antibody molecules of single molecular composition. A monoclonal antibody composition displays a single binding specificity and affinity for a particular epitope.

The term "human antibody" is intended to include antibodies having variable regions in which both the framework and CDR regions are derived from human germline immunoglobulin sequences. Furthermore, if the antibody contains a constant region, the constant region also is derived from human germline immunoglobulin sequences. The human antibodies of the invention can include amino acid residues not encoded by human germline immunoglobulin sequences (e.g., mutations introduced by random or site-specific mutagenesis in vitro or by somatic mutation in vivo). However, the term "human antibody," as used herein, is not intended to include antibodies in which CDR sequences derived from the germline of another mammalian species, such as a mouse, have been grafted onto human framework sequences.

The term "human monoclonal antibody" refers to antibodies displaying a single binding specificity, which have variable regions in which both the framework and CDR regions are derived from human germline immunoglobulin sequences. In one embodiment, the human monoclonal antibodies can be produced by a hybridoma that includes a B cell obtained from a transgenic nonhuman animal, e.g., a transgenic mouse, having a genome comprising a human heavy chain transgene and a light chain transgene fused to an immortalized cell.

The term "recombinant human antibody," as used herein, includes all human antibodies that are prepared, expressed, created or isolated by recombinant means, such as (a) antibodies isolated from an animal (e.g., a mouse) that is transgenic or transchromosomal for human immunoglobulin genes or a hybridoma prepared therefrom (described further below), (b) antibodies isolated from a host cell transformed to express the human antibody, e.g., from a transfectoma, (c) antibodies isolated from a recombinant, combinatorial human antibody library, and (d) antibodies prepared, expressed, created or isolated by any other means that involve splicing of human immunoglobulin gene sequences to other DNA sequences. Such recombinant human antibodies have variable regions in which the framework and CDR regions are derived from human germline immunoglobulin sequences. In some embodiments, however, such recombinant human antibodies can be subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo.

The term "isotype" refers to the antibody class (e.g., IgM or IgG1) that is encoded by the heavy chain constant region genes. The phrases "an antibody recognizing an antigen" and "an antibody specific for an antigen" are used interchangeably herein with the term "an antibody which binds specifically to an antigen."

The term "human antibody derivatives" refers to any modified form of the human antibody, e.g., a conjugate of the antibody and another agent or antibody. The term "humanized antibody" is intended to refer to antibodies in which CDR sequences derived from the germline of another mammalian species, such as a mouse, have been grafted onto human framework sequences. Additional framework region modifications can be made within the human framework sequences.

The term "chimeric antibody" is intended to refer to antibodies in which the variable region sequences are derived from one species, and the constant region sequences are derived from another species, such as an antibody in which the variable region sequences are derived from a mouse antibody, and the constant region sequences are derived from a human antibody. The term can also refer to an antibody in which its variable region sequence or CDR(s) is derived from one source (e.g., an IgA1 antibody) and the constant region sequence or Fc is derived from a different source (e.g., a different antibody, such as an IgG, IgA2, IgD, IgE or IgM antibody).

The invention encompasses isolated or substantially purified nucleic acids, peptides, polypeptides or proteins. In the context of the present invention, an "isolated" nucleic acid, DNA or RNA molecule or an "isolated" polypeptide is a nucleic acid, DNA molecule, RNA molecule, or polypeptide that exists apart from its native environment and is therefore not a product of nature. An isolated nucleic acid, DNA molecule, RNA molecule or polypeptide may exist in a purified form or may exist in a non-native environment such as, for example, a transgenic host cell. A "purified" nucleic acid molecule, peptide, polypeptide or protein, or a fragment thereof, is substantially free of other cellular material, or culture medium when produced by recombinant techniques, or substantially free of chemical precursors or other chemicals when chemically synthesized. In one embodiment, an "isolated" nucleic acid is free of sequences that naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived. A protein, peptide or polypeptide that is substantially free of cellular material includes preparations of protein, peptide or polypeptide having less than about 30%, 20%, 10%, or 5% (by dry weight) of contaminating protein. When the protein of the invention, or biologically active portion thereof, is recombinantly produced, preferably culture medium represents less than about 30%, 20%, 10%, or 5% (by dry weight) of chemical precursors or non-protein-of-interest chemicals.

The terms polypeptide, peptide, and protein are used interchangeably herein.

The terms "polypeptide," "peptide," and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, pegylation, or any other manipulation, such as conjugation with a labeling component. As used herein, the term "amino acid" includes natural and/or unnatural or synthetic amino acids, including glycine and both the D or L optical isomers, and amino acid analogs and peptidomimetics.

A peptide or polypeptide "fragment" as used herein refers to a less than full-length peptide, polypeptide or protein. For example, a peptide or polypeptide fragment can have is at least about 3, at least about 4, at least about 5, at least about 10, at least about 20, at least about 30, at least about 40 amino acids in length, or single unit lengths thereof. For example, fragment may be 6, 7, 8, 9, 10, 11, 12, 13, 14, 15, 16, 17, or more amino acids in length. There is no upper limit to the size of a peptide fragment. However, in some embodiments, peptide fragments can be less than about 500 amino acids, less than about 400 amino acids, less than about 300 amino acids or less than about 250 amino acids in length. Preferably the peptide fragment can elicit an immune response when used to inoculate an animal. A peptide fragment may be used to elicit an immune response by inoculating an animal with a peptide fragment in combination with an adjuvant, a peptide fragment that is coupled to an adjuvant, or a peptide fragment that is coupled to arsanilic acid, sulfanilic acid, an acetyl group, or a picryl group. A peptide fragment can include a non-amide bond and can be a peptidomimetic.

As used herein, the term "conjugate" or "conjugation" or "linked" as used herein refers to the attachment of two or more entities to form one entity. A conjugate encompasses both peptide-small molecule conjugates as well as peptide-protein/peptide conjugates.

The term "recombinant," as used herein, refers to antibodies or antigen-binding fragments thereof of the invention created, expressed, isolated or obtained by technologies or methods known in the art as recombinant DNA technology which include, e.g., DNA splicing and transgenic expression. The term refers to antibodies expressed in a non-human mammal (including transgenic non-human mammals, e.g., transgenic mice), or a cell (e.g., CHO cells) expression system or isolated from a recombinant combinatorial human antibody library.

A "nucleic acid" or "polynucleotide" refers to a DNA molecule (for example, but not limited to, a cDNA or genomic DNA) or an RNA molecule (for example, but not limited to, an mRNA), and includes DNA or RNA analogs. A DNA or RNA analog can be synthesized from nucleotide analogs. The DNA or RNA molecules may include portions that are not naturally occurring, such as modified bases, modified backbone, deoxyribonucleotides in an RNA, etc. The nucleic acid molecule can be single-stranded or double-stranded.

The term "substantial identity" or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 90%, and more preferably at least about 95%, 96%, 97%, 98% or 99% of the nucleotide bases, as measured by any well-known algorithm of sequence identity, such as FASTA, BLAST or GAP, as discussed below. A nucleic acid molecule having substantial identity to a reference nucleic acid molecule may, in certain instances, encode a polypeptide having the same or substantially similar amino acid sequence as the polypeptide encoded by the reference nucleic acid molecule.

As applied to polypeptides, the term "substantial similarity" or "substantially similar" means that two peptide sequences, when optimally aligned, such as by the programs GAP or BESTFIT using default gap weights, share at least 90% sequence identity, even more preferably at least 95%, 98% or 99% sequence identity. Preferably, residue positions, which are not identical, differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent or degree of similarity may be adjusted upwards to correct for the conservative nature of the substitution. Means for making this adjustment are well known to those of skill in the art. See, e.g., Pearson (1994) Methods Mol. Biol. 24: 307-331, which is herein incorporated by reference. Examples of groups of amino acids that have side chains with similar chemical properties include 1) aliphatic side chains: glycine, alanine, valine, leucine, and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartate and glutamate, and 7) sulfur-containing side chains: cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443 45, herein incorporated by reference. A "moderately conservative" replacement is any change having a nonnegative value in the PAM250 log-likelihood matrix.

Sequence similarity for polypeptides is typically measured using sequence analysis software. Protein analysis software matches similar sequences using measures of similarity assigned to various substitutions, deletions, and other modifications, including conservative amino acid substitutions. For instance, GCG software contains programs such as GAP and BESTFIT, which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA with default or recommended parameters; a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215: 403-410 and (1997) Nucleic Acids Res. 25:3389-3402, each of which is herein incorporated by reference.

As used herein, the term “affinity” refers to the strength of the sum total of noncovalent interactions between a single binding site of a molecule (e.g., an antibody) and its binding partner (e.g., an antigen). Unless indicated otherwise, as used herein, “binding affinity” refers to intrinsic binding affinity, which reflects a 1:1 interaction between members of a binding pair (e.g., antibody and antigen). The affinity of a molecule X for its partner Y can generally be represented by the dissociation constant (KD). Affinity can be measured by common methods known in the art, including those described herein.

The term “specifically binds,” or “binds specifically to,” or the like, refers to an antibody that binds to a single epitope, e.g., under physiologic conditions, but which does not bind to more than one epitope. Accordingly, an antibody that specifically binds to a polypeptide will bind to an epitope that present on the polypeptide, but which is not present on other polypeptides. Specific binding can be characterized by an equilibrium dissociation constant of at least about 1×10-8 M or less (e.g., a smaller KD denotes a tighter binding). Methods for determining whether two molecules specifically bind are well known in the art and include, for example, equilibrium dialysis, surface plasmon resonance, and the like. As described herein, antibodies have been identified by surface plasmon resonance, e.g., BIACORE™, which bind specifically to a Spike or S protein of SARS-CoV-2 virus.

Preferably, the antibody binds to a Spike or S protein with “high affinity,” namely with a KD of 1×10-7 M or less, more preferably 5×10-8 M or less, more preferably 3×10-8 M or less, more preferably 1×10-8 M or less, more preferably 5×10-9 M or less or even more preferably 1×10-9 M or less, as determined by surface plasmon resonance, e.g., BIACORE. The term “does not substantially bind” to a protein or cells, as used herein, means does not bind or does not bind with a high affinity to the protein or cells, i.e., binds to the protein or cells with a KD of 1×10-6 M or more, more preferably 1×10-5 M or more, more preferably 1×10-4 M or more, more preferably 1×10-3 M or more, even more preferably 1×10-2 M or more.

The term “Kassoc” or “Ka,” as used herein, is intended to refer to the association rate of a particular antibody-antigen interaction, whereas the term “Kdis” or “Kd,” as used herein, is intended to refer to the dissociation rate of a particular antibody-antigenn interaction. The term “KD,” as used herein, is intended to refer to the dissociation constant, which is obtained from the ratio of Kd to Ka (i.e., Kd/Ka) and is expressed as a molar concentration (M). KD values for antibodies can be determined using methods well established in the art. A preferred method for determining the KD of an antibody is by using surface plasmon resonance, preferably using a biosensor system such as a BIACORE system.

Antibodies that “compete with another antibody for binding to a target” refer to antibodies that inhibit (partially or completely) the binding of the other antibody to the target. Whether two antibodies compete with each other for binding to a target, i.e., whether and to what extent one antibody inhibits the binding of the other antibody to a target, may be determined using known competition experiments. In some embodiments, an antibody competes with, and inhibits binding of another antibody to a target by at least 10%, 20%, 30%, 40%, 50%, 60%, 70%, 80%, 90% or 100%. The level of inhibition or competition may be different depending on which antibody is the “blocking antibody” (i.e., the cold antibody that is incubated first with the target). Competition assays can be conducted as described, for example, in Ed Harlow and David Lane, Cold Spring Harb Protoc; 2006 or in Chapter 11 of “Using Antibodies” by Ed Harlow and David Lane, Cold Spring Harbor Laboratory Press, Cold Spring Harbor, NY, USA 1999. Competing antibodies bind to the same epitope, an overlapping epitope or to adjacent epitopes (e.g., as evidenced by steric hindrance). Other competitive binding assays include: solid phase direct or indirect radioimmunoassay (RIA), solid phase direct or indirect enzyme immunoassay (EIA), sandwich competition assay (see Stahli et al., Methods in Enzymology 9:242 (1983)); solid phase direct biotin-avidin EIA (see Kirkland et al., J. Immunol. 137:3614 (1986)); solid phase direct labeled assay, solid phase direct labeled sandwich assay (see Harlow and Lane, Antibodies: A Laboratory Manual, Cold Spring Harbor Press (1988)); solid phase direct label RIA using 1-125 label (see Morel et al., Mol. Immunol. 25(1):7 (1988)); solid phase direct biotin-avidin EIA (Cheung et al., Virology 176:546 (1990)); and direct labeled RIA. (Moldenhauer et al., Scand. J. Immunol. 32:77 (1990)).

The term “epitope” as used herein refers to an antigenic determinant that interacts with a specific antigen-binding site in the variable region of an antibody molecule known as a paratope. A single antigen may have more than one epitope. Thus, different antibodies may bind to different areas on an antigen and may have different biological effects. The term “epitope” also refers to a site on an antigen to which B and/or T cells respond. It also refers to a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of non-linear amino acids. In some embodiments, epitopes may include determinants that are chemically active surface groupings of molecules such as amino acids, sugar side chains, phosphoryl groups, or sulfonyl groups, and, In some embodiments, may have specific three-dimensional structural characteristics, and/or specific charge characteristics. An epitope typically includes at least 3, 4, 5, 6, 7, 8, 9, 10, 11, 12, 13, 14 or 15 amino acids in a unique spatial conformation. Methods for determining what epitopes are bound by a given antibody (i.e., epitope mapping) are well known in the art and include, for example, immunoblotting and immune-precipitation assays, wherein overlapping or contiguous peptides from a Spike or S protein are tested for reactivity with a given antibody. Methods of determining spatial conformation of epitopes include techniques in the art and those described herein, for example, x-ray crystallography and 2-dimensional nuclear magnetic resonance (see, e.g., Epitope Mapping Protocols in Methods in Molecular Biology, Vol. 66, G. E. Morris, Ed. (1996)).

The term "epitope mapping" refers to the process of identification of the molecular determinants for antibody-antigen recognition.

The term "binds to an epitope" or "recognizes an epitope" with reference to an antibody or antibody fragment refers to continuous or discontinuous segments of amino acids within an antigen. Those of skill in the art understand that the terms do not necessarily mean that the antibody or antibody fragment is in direct contact with every amino acid within an epitope sequence.

The term "binds to the same epitope" with reference to two or more antibodies means that the antibodies bind to the same, overlapping or encompassing continuous or discontinuous segments of amino acids. Those of skill in the art understand that the phrase "binds to the same epitope" does not necessarily mean that the antibodies bind to or contact exactly the same amino acids. The precise amino acids that the antibodies contact can differ. For example, a first antibody can bind to a segment of amino acids that is completely encompassed by the segment of amino acids bound by a second antibody. In another example, a first antibody binds one or more segments of amino acids that significantly overlap the one or more segments bound by the second antibody. For the purposes herein, such antibodies are considered to "bind to the same epitope."

As used herein, the term "immune response" refers to a biological response within a vertebrate against foreign agents, which response protects the organism against these agents and diseases caused by them. An immune response is mediated by the action of a cell of the immune system (for example, a T lymphocyte, B lymphocyte, natural killer (NK) cell, macrophage, eosinophil, mast cell, dendritic cell or neutrophil) and soluble macromolecules produced by any of these cells or the liver (including antibodies, cytokines, and complement) that results in selective targeting, binding to, damage to, destruction of, and/or elimination from the vertebrate's body of invading pathogens, cells or tissues infected with pathogens, cancerous or other abnormal cells, or, in cases of autoimmunity or pathological inflammation, normal human cells or tissues. An immune reaction includes, e.g., activation or inhibition of a T cell, e.g., an effector T cell or a Th cell, such as a CD4+ or CD8+ T cell, or the inhibition of a Treg cell.

The term "detectable label" as used herein refers to a molecule capable of detection, including, but not limited to, radioactive isotopes, fluorescers, chemiluminescers, chromophores, enzymes, enzyme substrates, enzyme cofactors, enzyme inhibitors, chromophores, dyes, metal ions, metal sols, ligands (e.g., biotin, avidin, streptavidin or haptens), intercalating dyes and the like. The term "fluorescer" refers to a substance or a portion thereof that is capable of exhibiting fluorescence in the detectable range.

In many embodiments, the terms "subject" and "patient" are used interchangeably irrespective of whether the subject has or is currently undergoing any form of treatment. As used herein, the terms "subject" and "subjects" may refer to any vertebrate, including, but not limited to, a mammal (e.g., cow, pig, camel, llama, horse, goat, rabbit, sheep, hamsters, guinea pig, cat, dog, rat, and mouse, a non-human primate (for example, a monkey, such as a cynomolgus monkey, chimpanzee, etc.) and a human). The subject may be a human or a non-human. In more exemplary aspects, the mammal is a human. As used herein, the expression "a subject in need thereof" or "a patient in need thereof" means a human or non-human mammal that exhibits one or more symptoms or indications of disorders (e.g., neuronal disorders, autoimmune diseases, and cardiovascular diseases), and/or who has been diagnosed with inflammatory disorders. In some embodiments, the subject is a mammal. In some embodiments, the subject is human.

As used herein, the term "disease" is intended to be generally synonymous and is used interchangeably with, the terms "disorder" and "condition" (as in medical condition), in that all reflect an abnormal condition (e.g., inflammatory disorder) of the human or animal body or of one of its parts that impairs normal functioning, is typically manifested by distinguishing signs and symptoms, and causes the human or animal to have a reduced duration or quality of life.

As used herein, the term "treating" or "treatment" of any disease or disorder refers in one embodiment, to ameliorating the disease or disorder (i.e., arresting or reducing the development of the disease or at least one of the clinical symptoms thereof). In another embodiment, "treating" or "treatment" refers to ameliorating at least one physical parameter, which may not be discernible by the patient. In yet another embodiment, "treating" or "treatment" refers to modulating the disease or disorder, either physically, (e.g., stabilization of a discernible symptom), physiologically, (e.g., stabilization of a physical parameter), or both. In yet another embodiment, "treating" or "treatment" refers to preventing or delaying the onset or development or progression of the disease or disorder.

The terms "prevent," "preventing," "prevention," "prophylactic treatment" and the like refer to reducing the probability of developing a disorder or condition in a subject, who does not have, but is at risk of or susceptible to developing a disorder or condition.

The terms "decrease," "reduced," "reduction," "decrease," or "inhibit" are all used herein generally to mean a decrease by a statistically significant amount. However, for avoidance of doubt, "reduced," "reduction" or "decrease" or "inhibit" means a decrease by at least 10% as compared to a reference level, for example, a decrease by at least about 20%, or at least about 30%, or at least about 40%, or at least about 50%, or at least about 60%, or at least about 70%, or at least about 80%, or at least about 90% or up to and including a 100% decrease (e.g., absent level as compared to a reference sample), or any decrease between 10-100% as compared to a reference level.

As used herein, the term "agent" denotes a chemical compound, a mixture of chemical compounds, a biological macromolecule (such as a nucleic acid, an antibody, a protein or portion thereof, e.g., a peptide), or an extract made from biological materials such as bacteria, plants, fungi, or animal (particularly mammalian) cells or tissues. The activity of such agents may render it suitable as a "therapeutic agent," which is a biologically, physiologically, or pharmacologically active substance (or substances) that acts locally or systemically in a subject.

As used herein, the terms "therapeutic agent," "therapeutic capable agent," or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder, or condition; and generally counteracting a disease, symptom, disorder or pathological condition.

The term "therapeutic effect" is art-recognized and refers to a local or systemic effect in animals, particularly mammals, and more particularly humans caused by a pharmacologically active sub stance.

The term "effective amount," "effective dose," or "effective dosage" is defined as an amount sufficient to achieve or at least partially achieve a desired effect. A "therapeutically effective amount" or "therapeutically effective dosage" of a drug or therapeutic agent is any amount of the drug that, when used alone or in combination with another therapeutic agent, promotes disease regression evidenced by a decrease in severity of disease symptoms, an increase in frequency and duration of disease symptom-free periods, or a prevention of impairment or disability due to the disease affliction. A "prophylactically effective amount" or a "prophylactically effective dosage" of a drug is an amount of the drug that, when administered alone or in combination with another therapeutic agent to a subject at risk of developing a disease or of suffering a recurrence of disease, inhibits the development or recurrence of the disease. The ability of a therapeutic or prophylactic agent to promote disease regression or inhibit the development or recurrence of the disease can be evaluated using a variety of methods known to the skilled practitioner, such as in human subjects during clinical trials, in animal model systems predictive of efficacy in humans, or by assaying the activity of the agent in in vitro assays.

Doses are often expressed in relation to bodyweight. Thus, a dose which is expressed as [g, mg, or other unit]/kg (or g, mg etc.) usually refers to [g, mg, or other unit] "per kg (or g, mg etc.) bodyweight," even if the term "bodyweight" is not explicitly mentioned.

As used herein, the term "composition" or "pharmaceutical composition" refers to a mixture of at least one component useful within the invention with other components, such as carriers, stabilizers, diluents, dispersing agents, suspending agents, thickening agents, and/or excipients. The pharmaceutical composition facilitates administration of one or more components of the invention to an organism.

As used herein, the term "pharmaceutically acceptable" refers to a material, such as a carrier or diluent, which does not abrogate the biological activity or properties of the composition, and is relatively non-toxic, i.e., the material may be administered to an individual without causing undesirable biological effects or interacting in a deleterious manner with any of the components of the composition in which it is contained.

As used herein, the term "pharmaceutically acceptable carrier" includes a pharmaceutically acceptable salt, pharmaceutically acceptable material, composition or carrier, such as a liquid or solid filler, diluent, excipient, solvent or encapsulating material, involved in carrying or transporting a compound(s) of the present invention within or to the subject such that it may perform its intended function. Typically, such compounds are carried or transported from one organ, or portion of the body, to another organ, or portion of the body. Each salt or carrier must be "acceptable" in the sense of being compatible with the other ingredients of the formulation and not injurious to the subject. Some examples of materials that may serve as pharmaceutically acceptable carriers include: sugars, such as lactose, glucose, and sucrose; starches, such as corn starch and potato starch; cellulose, and its derivatives, such as sodium carboxymethyl cellulose, ethyl cellulose, and cellulose acetate; powdered tragacanth; malt; gelatin; talc; excipients, such as cocoa butter and suppository waxes; oils, such as peanut oil, cottonseed oil, safflower oil, sesame oil, olive oil, corn oil, and soybean oil; glycols, such as propylene glycol; polyols, such as glycerin, sorbitol, mannitol, and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; phosphate buffer solutions; diluent; granulating agent; lubricant; binder; disintegrating agent; wetting agent; emulsifier; coloring agent; release agent; coating agent; sweetening agent; flavoring agent; perfuming agent; preservative; antioxidant; plasticizer; gelling agent; thickener; hardener; setting agent; suspending agent; surfactant; humectant; carrier; stabilizer; and other non-toxic compatible substances employed in pharmaceutical formulations, or any combination thereof. As used herein, "pharmaceutically acceptable carrier" also includes any and all coatings, antibacterial and antifungal agents, and absorption delaying agents, and the like that are compatible with the activity of one or more components of the invention, and are physiologically acceptable to the subject. Supplementary active compounds may also be incorporated into the compositions.

"Combination" therapy, as used herein, unless otherwise clear from the context, is meant to encompass administration of two or more therapeutic agents in a coordinated fashion and includes, but is not limited to, concurrent dosing. Specifically, combination therapy encompasses both co-administration (e.g., administration of a co-formulation or simultaneous administration of separate therapeutic compositions) and serial or sequential administration, provided that administration of one therapeutic agent is conditioned in some way on the administration of another therapeutic agent. For example, one therapeutic agent may be administered only after a different therapeutic agent has been administered and allowed to act for a prescribed period of time. See, e.g., Kohrt et al. (2011) Blood 117:2423.

As used herein, the term "co-administration" or "co-administered" refers to the administration of at least two agent(s) or therapies to a subject. In some embodiments, the co-administration of two or more agents/therapies is concurrent. In other embodiments, a first agent/therapy is administered prior to a second agent/therapy. Those of skill in the art understand that the formulations and/or routes of administration of the various agents/therapies used may vary.

As used herein, the term "contacting," when used in reference to any set of components, includes any process whereby the components to be contacted are mixed into the same mixture (for example, are added into the same compartment or solution), and does not necessarily require actual physical contact between the recited components. The recited components can be contacted in any order or any combination (or sub-combination) and can include situations where one or some of the recited components are subsequently removed from the mixture, optionally prior to addition of other recited components. For example, "contacting A with B and C" includes any and all of the following situations: (i) A is mixed with C, then B is added to the mixture; (ii) A and B are mixed into a mixture; B is removed from the mixture, and then C is added to the mixture; and (iii) A is added to a mixture of B and C.

"Sample," "test sample," and "patient sample" may be used interchangeably herein. The sample can be a sample of serum, urine plasma, amniotic fluid, cerebrospinal fluid, cells, or tissue. Such a sample can be used directly as obtained from a patient or can be pre-treated, such as by filtration, distillation, extraction, concentration, centrifugation, inactivation of interfering components, addition of reagents, and the like, to modify the character of the sample in some manner as discussed herein or otherwise as is known in the art. The terms "sample" and "biological sample" as used herein generally refer to a biological material being tested for and/or suspected of containing an analyte of interest such as antibodies. The sample may be any tissue sample from the subject. The sample may comprise protein from the subject.

As used herein, the term "in vitro" refers to events that occur in an artificial environment, e.g., in a test tube or reaction vessel, in cell culture, etc., rather than within a multi-cellular organism.

As used herein, the term "in vivo" refers to events that occur within a multi-cellular organism, such as a non-human animal.

As used herein, the singular forms "a," "an," and "the" include plural references unless the context clearly dictates otherwise.

As used herein, the terms "including," "comprising," "containing," or "having" and variations thereof are meant to encompass the items listed thereafter and equivalents thereof as well as additional subject matter unless otherwise noted.

As used herein, the phrases "in one embodiment," "in various embodiments," "in some embodiments," and the like are used repeatedly. Such phrases do not necessarily refer to the same embodiment, but they may unless the context dictates otherwise.

As used herein, the terms "and/or" or "/" means any one of the items, any combination of the items, or all of the items with which this term is associated.

As used herein, the word "substantially" does not exclude "completely," e.g., a composition which is "substantially free" from Y may be completely free from Y. Where necessary, the word "substantially" may be omitted from the definition of the invention.

As used herein, the term "each," when used in reference to a collection of items, is intended to identify an individual item in the collection but does not necessarily refer to every item in the collection. Exceptions can occur if explicit disclosure or context clearly dictates otherwise.

As used herein, the term "approximately" or "about," as applied to one or more values of interest, refers to a value that is similar to a stated reference value. In some embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value). Unless indicated otherwise herein, the term "about" is intended to include values, e.g., weight percents, proximate to the recited range that are equivalent in terms of the functionality of the individual ingredient, the composition, or the embodiment.

As disclosed herein, a number of ranges of values are provided. It is understood that each intervening value, to the tenth of the unit of the lower limit, unless the context clearly dictates otherwise, between the upper and lower limits of that range is also specifically disclosed. Each smaller range between any stated value or intervening value in a stated range and any other stated or intervening value in that stated range is encompassed within the invention. The upper and lower limits of these smaller ranges may independently be included or excluded in the range, and each range where either, neither, or both limits are included in the smaller ranges is also encompassed within the invention, subject to any specifically excluded limit in the stated range. Where the stated range includes one or both of the limits, ranges excluding either or both of those included limits are also included in the invention.

The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

All methods described herein are performed in any suitable order unless otherwise indicated herein or otherwise clearly contradicted by context. In regard to any of the methods provided, the steps of the method may occur simultaneously or sequentially. When the steps of the method occur sequentially, the steps may occur in any order, unless noted otherwise. In cases in which a method comprises a combination of steps, each and every combination or sub-combination of the steps is encompassed within the scope of the disclosure, unless otherwise noted herein.

Each publication, patent application, patent, and other reference cited herein is incorporated by reference in its entirety to the extent that it is not inconsistent with the present disclosure. Publications disclosed herein are provided solely for their disclosure prior to the filing date of the present invention. Nothing herein is to be construed as an admission that the present invention is not entitled to antedate such publication by virtue of prior invention. Further, the dates of publication provided may be different from the actual publication dates, which may need to be independently confirmed.

It is understood that the examples and embodiments described herein are for illustrative purposes only and that various modifications or changes in light thereof will be suggested to persons skilled in the art and are to be included within the spirit and purview of this application and scope of the appended claims.

EXAMPLES

Infection is associated with development of variable levels of antibodies with neutralizing activity that can protect against infection in animal models. Antibody levels decrease with time, but the nature and quality of the memory B cells that would be called upon to produce antibodies upon re-infection has not been examined. This example describes the humoral memory response in a cohort of 87 individuals assessed at 1.3 and 6.2 months after infection. It was found that IgM, IgA, and IgG anti-SARS-CoV-2 spike protein receptor binding domain (RBD) antibody titers decrease significantly with IgA being less affected. Concurrently, neutralizing activity in plasma decreases by five-fold in pseudotype virus assays. In contrast, the number of RBD-specific memory B cells is unchanged. The memory B cells display clonal evolution after 6.2 months, and antibodies have greater somatic hypermutation, increased potency and resistance to RBD mutations, indicative of continued evolution of the humoral response. Analysis of intestinal biopsies obtained from asymptomatic individuals 3 months after COVID-19 onset, using immunofluorescence, electron tomography and polymerase chain reaction, revealed persistence of SARS-CoV-2 in the small bowel of 6 out of 14 volunteers. It was concluded that the memory B cell response to SARS-CoV-2 evolves between 1.3 and 6.2 months after infection in a manner that is consistent with antigen persistence.

Figures 6A, 6B:
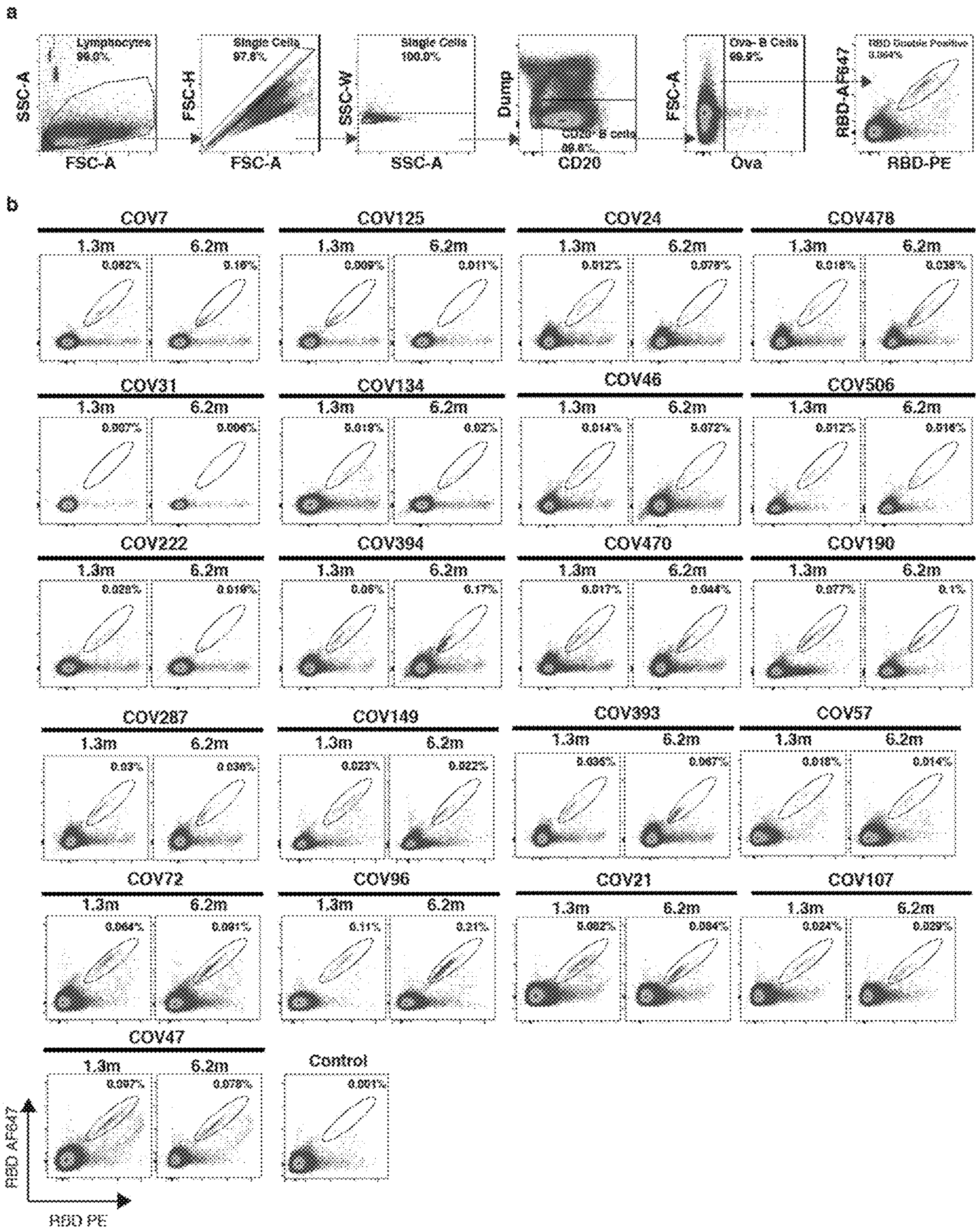
FIGS. 6*a* and 6*b* show flow cytometry.

Antibody responses to SARS-CoV-2 were initially characterized in a cohort of COVID-19-convalescent individuals approximately 40 days (1.3 months) after infection. Between 31 Aug. and 16 Oct. 2020, 100 participants returned for a 6-month follow-up study visit. Although initial criteria allowed enrollment of close contacts of individuals diagnosed with RT-PCR confirmed SARS-CoV-2 infection, 13 of the contacts did not seroconvert and were excluded from further analyses. The remaining 87 participants with RT-PCR-confirmed COVID-19 diagnosis and/or seroconversion returned for analysis approximately 191 days (6.2 months, range: 165-223 days) after the onset of symptoms. In this cohort, symptoms lasted for a median of 12 days (0-44 days) during the acute phase, and 10 (11%) of the participants were hospitalized. 38 (44%) of the participants reported persistent long-term symptoms attributable to COVID-19 (Methods and Tables 1 and 2). The duration and severity of symptoms during acute disease was significantly greater among participants with persistent post-acute symptoms at the second study visit (FIGS. 6*m*-*o*). Importantly, all 87 participants tested negative for SARS-CoV-2 using an approved saliva-based PCR assay (Methods) at the 6-month follow-up study visit. Participant demographics and clinical characteristics are shown in Tables land 2.

TABLE 1

Cohort characteristics

| Sex | n | Age (years) | Temporal dynamics (days): Sx onset to initial visit (T1) | Sx onset to follow-up visit (T2) | Time between visits | Acute disease severity by WHO (0-8) ¶ | Post-acute Sx persistence † | ELISA binding: RBD (AUC) IgG (T1) | IgG (T2) | IgM (T1) | IgM (T2) | IgA (T1) | IgA (T2) | N (COI) total Ig (T1) | total Ig (T2) | Neutralization (NT50) (T1) | (T2) |
|---|---|---|---|---|---|---|---|---|---|---|---|---|---|---|---|---|---|
| Male | 52 | 44.5 (24-76) | 39 (21-63) | 190 (165-211) | 148 (119-178) | 2 (0-6) | 25/52 (48.1%) | 11632 | 6697 | 2811 | 1502 | 1411 | 1218 | 47.8 | 53.9 | 649 | 78 |
| Female | 35 | 45 (26-73) | 36 (17-67) | 192 (168-223) | 154 (122-179 | 2 (0-5) | 13/35 (37.1%) | 8884 | 6834 | 2358 | 1459 | 1235 | 1083 | 59.8 | 56.8 | 297 | 87 |

Sx = Symptoms
¶ = WHO Ordinal Scale for Clinical Improvement, COVID-19 Trial Design Synopsis
† = Persistent fatigue, dyspnea, athletic deficit, or ≥3 other solicited symptoms beyond 6 weeks from Sx onset
Reported data are median (range) unless stated otherwise

TABLE 2

Individual participant characteristics

| ID | Age (years) | Sex | Race | Ethnicity | Temporal dynamics (days): Sx duration during acute disease | Sx onset to initial visit (T1) | Sx onset to follow-up visit (T2) | Time between visits | # of solicited comorbidities § | Acute disease severity by WHO (0-8) ¶ | Post-acute Sx persistence † |
|---|---|---|---|---|---|---|---|---|---|---|---|
| 7 | 40 | M | White | Non-Hispanic | 11 | 30 | 181 | 151 | 0 | 2 | Y |
| 8 | 37 | M | White | Non-Hispanic | 3 | 57 | 205 | 148 | 0 | 2 | Y |
| 9 | 35 | F | White | Non-Hispanic | 12 | 53 | 201 | 148 | 0 | 2 | Y |
| 20 | 26 | F | White | Non-Hispanic | 2 | 17 | 191 | 174 | 1 | 2 | N |
| 21 | 54 | M | White | Hispanic | 11 | 27 | 200 | 173 | 1 | 2 | Y |
| 24 | 34 | M | White | Non-Hispanic | 15 | 30 | 175 | 145 | 1 | 1 | N |
| 27 | 28 | M | White | Non-Hispanic | 9 | 32 | 210 | 178 | 1 | 1 | Y |
| 31 | 51 | M | White | Non-Hispanic | 9 | 33 | 183 | 150 | 0 | 2 | Y |
| 38 | 57 | F | White | Non-Hispanic | 10 | 38 | 211 | 173 | 0 | 2 | N |
| 40 | 44 | M | White | Non-Hispanic | 7 | 23 | 195 | 172 | 0 | 2 | N |
| 46 | 39 | M | White | Non-Hispanic | 8 | 30 | 174 | 144 | 0 | 2 | Y |
| 47 | 43 | F | White | Non-Hispanic | 11 | 33 | 177 | 144 | 0 | 2 | Y |

TABLE 2-continued

Individual participant characteristics

| | | | | | | | | | | | |
|---|---|---|---|---|---|---|---|---|---|---|---|
| 48 | 37 | F | White | Non-Hispanic | 7 | 21 | 174 | 153 | 0 | 2 | N |
| 55 | 36 | M | White | Non-Hispanic | 3 | 49 | 210 | 161 | 0 | 2 | N |
| 57 | 66 | M | White | Non-Hispanic | 6 | 21 | 180 | 159 | 4 | 2 | N |
| 71 | 45 | F | White | Non-Hispanic | 12 | 48 | 202 | 154 | 0 | 2 | Y |
| 72 | 42 | M | White | Non-Hispanic | 16 | 35 | 188 | 153 | 1 | 2 | Y |
| 75 | 46 | F | White | Non-Hispanic | 10 | 36 | 212 | 176 | 0 | 1 | N |
| 76 | 49 | F | White | Non-Hispanic | 28 | 34 | 204 | 170 | 0 | 1 | Y |
| 82** | 46 | M | N/A | Non-Hispanic | 0 | N/A | N/A | 163 | 0 | 1 | N |
| 88 | 41 | M | White | Non-Hispanic | 7 | 23 | 180 | 157 | 1 | 1 | N |
| 95 | 44 | M | White | Non-Hispanic | 9 | 36 | 204 | 168 | 1 | 2 | Y |
| 96 | 48 | F | White | Non-Hispanic | 9 | 30 | 194 | 164 | 0 | 1 | N |
| 98 | 35 | F | White | Non-Hispanic | 2 | 24 | 203 | 179 | 0 | 2 | N |
| 99 | 36 | F | White | Non-Hispanic | 13 | 29 | 204 | 175 | 0 | 2 | N |
| 107 | 53 | F | White | Non-Hispanic | 10 | 29 | 202 | 173 | 0 | 2 | Y |
| 114 | 30 | F | White | Non-Hispanic | 15 | 36 | 195 | 159 | 0 | 2 | Y |
| 115 | 65 | F | White | Non-Hispanic | 20 | 41 | 188 | 147 | 0 | 2 | N |
| 119 | 56 | M | White | Non-Hispanic | 13 | 48 | 207 | 159 | 0 | 1 | N |
| 120 | 56 | F | White | Non-Hispanic | 26 | 48 | 207 | 159 | 0 | 1 | N |
| 123 | 26 | M | White | Non-Hispanic | 12 | 34 | 191 | 157 | 0 | 2 | Y |
| 125 | 51 | F | White | Non-Hispanic | 10 | 26 | 168 | 142 | 0 | 1 | N |
| 131 | 39 | M | White | Non-Hispanic | 5 | 25 | 191 | 166 | 0 | 0 | N |
| 132 | 36 | M | White | Non-Hispanic | 10 | 50 | 193 | 143 | 0 | 0 | N |
| 134 | 27 | F | White | Non-Hispanic | 16 | 22 | 171 | 149 | 0 | 0 | N |
| 135 | 62 | F | White | Non-Hispanic | 8 | 31 | 190 | 159 | 0 | 2 | N |
| 140 | 63 | F | White | Non-Hispanic | 28 | 47 | 223 | 176 | 0 | 1 | N |
| 149 | 41 | M | White | Non-Hispanic | 17 | 28 | 173 | 145 | 1 | 2 | N |
| 154 | 68 | M | Asian | Non-Hispanic | 16 | 30 | 196 | 166 | 3 | 2 | Y |
| 157 | 50 | M | White | Non-Hispanic | 10 | 32 | 179 | 147 | 0 | 1 | N |
| 172 | 38 | F | White | Non-Hispanic | 8 | 22 | 182 | 160 | 1 | 2 | N |
| 173 | 47 | M | White | Non-Hispanic | 5 | 53 | 185 | 132 | 0 | 2 | N |
| 178 | 26 | F | White | Non-Hispanic | 6 | 24 | 190 | 166 | 1 | 1 | N |
| 186 | 38 | F | N/A | N/A | 8 | 33 | 189 | 156 | 0 | 1 | N |
| 190* | 54 | F | White | Non-Hispanic | 18 | 63 | 190 | 127 | 0 | 4 | Y |
| 192* | 47 | F | White | Non-Hispanic | 44 | 62 | 190 | 128 | 1 | 3 | Y |
| 195 | 24 | M | White | Non-Hispanic | 18 | 42 | 191 | 149 | 0 | 2 | N |
| 201 | 50 | M | White | Non-Hispanic | 15 | 33 | 185 | 152 | 1 | 2 | N |
| 222 | 28 | M | Asian | Non-Hispanic | 11 | 37 | 173 | 136 | 1 | 2 | N |
| 229 | 45 | M | White | Non-Hispanic | 10 | 63 | 203 | 140 | 1 | 2 | N |
| 230 | 50 | M | White | Non-Hispanic | 18 | 33 | 190 | 157 | 0 | 2 | Y |

TABLE 2-continued

| Individual participant characteristics | | | | | | | | | | | |
|---|---|---|---|---|---|---|---|---|---|---|---|
| 232 | 38 | F | White | Non-Hispanic | 13 | 43 | 197 | 154 | 1 | 2 | N |
| 233 | 55 | M | White | Non-Hispanic | 20 | 41 | 206 | 165 | 0 | 2 | N |
| 241 | 36 | M | White | Non-Hispanic | 12 | 30 | 202 | 172 | 1 | 2 | N |
| 256 | 63 | F | White | Non-Hispanic | 27 | 42 | 217 | 175 | 0 | 2 | Y |
| 287 | 47 | M | White | Non-Hispanic | 11 | 23 | 165 | 142 | 0 | 1 | N |
| 310 | 34 | F | White | Non-Hispanic | 17 | 35 | 185 | 150 | 0 | 2 | Y |
| 314 | 46 | M | White | Non-Hispanic | 11 | 43 | 184 | 141 | 0 | 2 | Y |
| 315 | 29 | F | White | Non-Hispanic | 15 | 42 | 190 | 148 | 0 | 1 | N |
| 319 | 50 | M | White | Non-Hispanic | 5 | 38 | 180 | 142 | 1 | 2 | N |
| 323 | 39 | F | White | Non-Hispanic | 7 | 45 | 185 | 140 | 0 | 2 | N |
| 325 | 52 | M | White | Non-Hispanic | 16 | 38 | 192 | 154 | 0 | 2 | Y |
| 328 | 54 | F | White | Non-Hispanic | 22 | 62 | 203 | 141 | 0 | 2 | N |
| 352 | 44 | M | White | Non-Hispanic | 16 | 43 | 197 | 154 | 0 | 2 | N |
| 353 | 60 | M | White | Non-Hispanic | 14 | 49 | 186 | 137 | 0 | 2 | Y |
| 393* | 69 | M | White | Non-Hispanic | 23 | 54 | 187 | 133 | 0 | 5 | N |
| 394 | 48 | F | Multiple | Hispanic | 7 | 67 | 200 | 133 | 2 | 2 | N |
| 401 | 61 | M | White | Non-Hispanic | 16 | 53 | 209 | 156 | 0 | 2 | Y |
| 403* | 52 | M | Asian | Non-Hispanic | 18 | 39 | 174 | 135 | 1 | 4 | Y |
| 410 | 34 | M | White | Non-Hispanic | 12 | 46 | 192 | 146 | 1 | 2 | Y |
| 437 | 43 | F | Asian | Non-Hispanic | 14 | 34 | 192 | 158 | 1 | 2 | N |
| 461 | 49 | M | White | Non-Hispanic | 7 | 39 | 185 | 146 | 2 | 2 | Y |
| 470 | 28 | F | White | Non-Hispanic | 17 | 51 | 173 | 122 | 0 | 2 | Y |
| 478 | 31 | M | White | Non-Hispanic | 16 | 52 | 172 | 120 | 0 | 1 | Y |
| 500 | 46 | M | White | Non-Hispanic | 12 | 53 | 207 | 154 | 0 | 2 | N |
| 501* | 32 | M | Asian | Non-Hispanic | 18 | 53 | 192 | 139 | 0 | 4 | Y |
| 506 | 46 | M | White | Non-Hispanic | 12 | 59 | 178 | 119 | 1 | 2 | Y |
| 507 | 39 | M | White | Non-Hispanic | 15 | 60 | 200 | 140 | 0 | 2 | Y |
| 509 | 36 | M | White | Non-Hispanic | 11 | 50 | 190 | 140 | 0 | 2 | N |
| 537 | 52 | M | White | Non-Hispanic | 15 | 45 | 178 | 133 | 2 | 2 | Y |
| 539* | 73 | F | White | Non-Hispanic | 19 | 55 | 209 | 154 | 1 | 5 | Y |
| 547* | 59 | M | White | Non-Hispanic | 15 | 36 | 211 | 175 | 0 | 3 | N |
| 632 | 38 | M | White | Non-Hispanic | 10 | 43 | 168 | 125 | 0 | 2 | Y |
| 633 | 39 | M | White | Non-Hispanic | 8 | 57 | 182 | 125 | 0 | 1 | N |
| 652* | 76 | M | White | Non-Hispanic | 18 | 56 | 211 | 155 | 2 | 6 | N |
| 664* | 45 | F | White | Non-Hispanic | 17 | 42 | 192 | 150 | 0 | 5 | Y |
| 674* | 41 | M | White | Non-Hispanic | 17 | 57 | 182 | 125 | 0 | 4 | Y |

TABLE 2-continued

Individual participant characteristics

| | Serological assays | | | | | | | | | | | | | |
|---|---|---|---|---|---|---|---|---|---|---|---|---|---|---|
| | | | | | | | | | | | N (COI) | | | |
| | RBD (AUC) | | | | RBD (Pylon, IV) | | | | | | total | total | Neutralization | |
| | IgG | IgG | IgM | IgM | IgA | IgA | IgG | IgG | IgM | IgM | Ig | Ig | (NT50) | |
| ID | (T1) | (T2) | (T1) | (T2) | (T1) | (T2) | (T1) | (T2) | (T1) | (T2) | (T1) | (T2) | (T1) | (T2) |
| 7 | 11981 | 9545 | 6524 | 1516 | 1479 | 1344 | 34 | 18 | 3.6 | 0.31 | 56 | 171 | 2730 | 192 |
| 8 | 9010 | 7653 | 1998 | 1153 | 1342 | 1380 | 6.9 | 4.9 | 0.27 | 0.26 | 43 | 16 | 151 | 39 |
| 9 | 18953 | 12848 | 2963 | 1753 | 989 | 1227 | 27 | 23 | 1.1 | 0.49 | 174 | 187 | 306 | 295 |
| 20 | 4134 | 8690 | 1976 | 1228 | 1018 | 1314 | 1.5 | 13 | 0.36 | 0.25 | 1 | 4 | 50 | 172 |
| 21 | 36389 | 20744 | 14506 | 1242 | 2855 | 1914 | 127 | 59 | 4.4 | 0.23 | 82 | 159 | 5053 | 561 |
| 24 | 5736 | 3803 | 2715 | 1150 | 927 | 1101 | 2.9 | 0.93 | 0.34 | 0.2 | 6 | 17 | 281 | 10 |
| 27 | 9283 | 5312 | 2182 | 1943 | 2182 | 1943 | 13 | 4.5 | 0.35 | 0.21 | 88 | 168 | 739 | 86 |
| 31 | 3212 | 3705 | 1272 | 903 | 906 | 913 | 1.3 | 1.5 | 0.22 | 0.15 | 35 | 41 | 192 | 18 |
| 38 | 13718 | 12760 | 2009 | 1249 | 2902 | 3198 | 11 | 59 | 0.24 | 0.35 | 49 | 35 | 519 | 832 |
| 40 | 5291 | 6467 | 1792 | 1161 | 1481 | 1501 | 0.6 | 0.6 | 0.33 | 0.15 | 3 | 12 | 64 | 10 |
| 46 | 4799 | 4416 | 2247 | 1315 | 1055 | 1153 | 3 | 2.2 | 0.24 | 0.17 | 51 | 141 | 59 | 21 |
| 47 | 17581 | 9284 | 9749 | 1914 | 1586 | 851 | 43 | 16 | 1.2 | 0.21 | 103 | 101 | 10433 | 349 |
| 48 | 3265 | 3681 | 2358 | 1952 | 802 | 898 | 2.8 | 3.9 | 0.27 | 0.23 | 2 | 10 | 173 | 22 |
| 55 | 12982 | 6419 | 2515 | 1487 | 2213 | 1466 | 16 | 3.3 | 0.27 | 0.19 | 85 | 17 | 186 | 10 |
| 57 | 9108 | 4987 | 9199 | 2622 | 954 | 884 | 23 | 4.6 | 1.7 | 0.35 | 19 | 128 | 2049 | 45 |
| 71 | 5207 | 4559 | 1606 | 998 | 723 | 860 | 3.5 | 6.6 | 0.14 | 0.33 | 21 | 33 | 112 | 65 |
| 72 | 24822 | 10485 | 24034 | 2095 | 4887 | 2407 | N/A | N/A | N/A | N/A | N/A | N/A | 3138 | 81 |
| 75 | 5083 | 3811 | 1386 | 1459 | 1386 | 1459 | 7.2 | 2.1 | 0.36 | 0.2 | 71 | 74 | 271 | 36 |
| 76 | 8354 | 5632 | 1697 | 1299 | 1320 | 886 | 5.1 | 0.67 | 0.23 | 0.22 | 3 | 2 | 220 | 10 |
| 82** | 6472 | 5187 | 2667 | 3094 | 1125 | 846 | N/A | N/A | N/A | N/A | N/A | N/A | 131 | 20 |
| 88 | 8263 | 6730 | 1789 | 2276 | 1546 | 903 | 4.7 | 9.3 | 0.56 | 0.31 | 7 | 186 | 425 | 56 |
| 95 | 14380 | 7894 | 2709 | 1703 | 1250 | 1023 | 18 | 7.2 | 0.42 | 0.12 | 136 | 235 | 962 | 155 |
| 96 | 24147 | 15675 | 3959 | 1498 | 1099 | 965 | N/A | N/A | N/A | N/A | N/A | N/A | 928 | 206 |
| 98 | 8275 | 7190 | 2495 | 2417 | 2495 | 2417 | 15 | 6.9 | 0.7 | 0.65 | 72 | 55 | 249 | 53 |
| 99 | 12764 | 6017 | 2693 | 2390 | 2693 | 2390 | 24 | 5.3 | 0.41 | 0.34 | 46 | 12 | 1128 | 163 |
| 107 | 7967 | 6298 | 1560 | 1025 | 915 | 850 | 3.8 | 6.3 | 0.49 | 0.18 | 64 | 76 | 297 | 87 |
| 114 | 5979 | 5654 | 1163 | 912 | 898 | 940 | N/A | N/A | N/A | N/A | N/A | N/A | 114 | 32 |
| 115 | 26997 | 11600 | 19944 | 2081 | 991 | 890 | 63 | 22 | 2.9 | 0.27 | 116 | 157 | 1128 | 432 |
| 119 | 12155 | 6663 | 7000 | 1533 | 2152 | 1822 | 13 | 4.2 | 14 | 1.1 | 20 | 23 | 650 | 35 |
| 120 | 6096 | 6292 | 2310 | 1091 | 856 | 1045 | 5.5 | 2.7 | 0.33 | 0.14 | 10 | 9 | 101 | 10 |
| 123 | 5977 | 6228 | 2722 | 1880 | 1127 | 1357 | 2.1 | 0.67 | 0.21 | 0.15 | 4 | 2 | 76 | 10 |
| 125 | 4498 | 4271 | 2234 | 1361 | 684 | 807 | 1.8 | 1.1 | 1 | 0.19 | 4 | 2 | 127 | 10 |
| 131 | 4285 | 3911 | 1318 | 943 | 1201 | 1166 | 0.27 | 0.93 | 0.35 | 0.26 | 1 | 3 | 50 | 14 |
| 132 | 12506 | 8783 | 8532 | 4822 | 1068 | 1070 | 10 | 9.8 | 0.81 | 0.26 | 161 | 149 | 521 | 200 |
| 134 | 8884 | 6818 | 7472 | 2068 | 1057 | 982 | 4.1 | 3.7 | 2.1 | 0.37 | 15 | 6 | 2701 | 263 |
| 135 | 9301 | 8386 | 3157 | 888 | 1256 | 952 | 9.9 | 16 | 0.77 | 0.21 | 50 | 81 | 350 | 441 |
| 140 | 6181 | 4957 | 1235 | 1061 | 1235 | 1061 | 3.5 | 2.2 | 0.22 | 0.12 | 39 | 14 | 52 | 13 |
| 149 | 6275 | 3875 | 1422 | 1073 | 1058 | 842 | 10 | 3.4 | 0.48 | 0.21 | 69 | 151 | 495 | 28 |
| 154 | 25056 | 13409 | 5544 | 1169 | 2072 | 1205 | 57 | 16 | 2.9 | 0.18 | 13 | 23 | 928 | 65 |
| 157 | 11979 | 8751 | 11125 | 2370 | 1969 | 1374 | 15 | 7.9 | 5.4 | 0.71 | 67 | 89 | 742 | 190 |
| 172 | 10507 | 6124 | 4007 | 1339 | 3230 | 1244 | 5.2 | 5.1 | 0.85 | 0.21 | 14 | 102 | 301 | 157 |
| 173 | 9127 | 5004 | 12194 | 1660 | 1162 | 979 | 2.5 | 2.8 | 7.3 | 0.59 | 149 | 143 | 647 | 176 |
| 178 | 4316 | 3757 | 1394 | 1373 | 1351 | 1222 | 1.2 | 0.73 | 0.43 | 0.49 | 2 | 3 | 10 | 10 |
| 186 | 7427 | 4850 | 1687 | 960 | 1085 | 815 | 10 | 5 | 0.41 | 0.29 | 64 | 32 | 297 | 73 |
| 190* | 16156 | 10408 | 4567 | 1664 | 1207 | 1107 | 43 | 18 | 0.9 | 0.42 | 102 | 81 | 598 | 165 |
| 192* | 13879 | 9000 | 5894 | 1525 | 1819 | 1598 | 30 | 22 | 0.68 | 0.38 | 106 | 145 | 608 | 409 |
| 195 | 14242 | 7933 | 3954 | 2055 | 1227 | 978 | 22 | 6.9 | 1.5 | 0.24 | 15 | 31 | 1315 | 106 |
| 201 | 26093 | 11284 | 6230 | 1635 | 3374 | 1477 | 131 | 48 | 3.3 | 0.23 | 34 | 69 | 3897 | 741 |
| 222 | 14063 | 6930 | 1132 | 723 | 2841 | 1612 | 7.9 | 2.7 | 0.37 | 0.18 | 14 | 17 | 865 | 50 |
| 229 | 14677 | 8054 | 5507 | 1606 | 1066 | 1141 | 31 | 19 | 0.49 | 0.25 | 146 | 191 | 1273 | 135 |
| 230 | 5605 | 5015 | 1300 | 1868 | 1059 | 1130 | 1.8 | 1.5 | 0.19 | 0.17 | 6 | 10 | 382 | 375 |
| 232 | 8127 | 15997 | 1948 | 2352 | 1335 | 1362 | N/A | N/A | N/A | N/A | N/A | N/A | 147 | 633 |
| 233 | 6897 | 6940 | 1917 | 1211 | 1066 | 1065 | 8.3 | 4.3 | 0.27 | 0.16 | 3 | 9 | 173 | 11 |
| 241 | 8912 | 5749 | 7327 | 1446 | 2562 | 2195 | 3.3 | 0.8 | 1.4 | 0.38 | 69 | 18 | 923 | 118 |
| 256 | 10574 | 6500 | 1886 | 1533 | 1886 | 1533 | 7.7 | 6.4 | 0.34 | 0.17 | 65 | 27 | 142 | 31 |
| 287 | 7442 | 4357 | 2873 | 1211 | 910 | 928 | 9.3 | 3.9 | 0.77 | 0.41 | 15 | 15 | 240 | 38 |
| 310 | 26782 | 15634 | 1554 | 1023 | 1435 | 1083 | 47 | 15 | 0.27 | 0.31 | 51 | 137 | 485 | 153 |
| 314 | 12475 | 7247 | 2431 | 1273 | 854 | 811 | 38 | 14 | 0.89 | 0.2 | 131 | 198 | 667 | 297 |
| 315 | 18570 | 13153 | 2528 | 2022 | 1252 | 1083 | 55 | 21 | 0.75 | 0.31 | 135 | 58 | 376 | 179 |
| 319 | 7614 | 4736 | 2215 | 762.1 | 1575 | 1174 | 6.9 | 3.9 | 0.26 | 0.16 | 27 | 12 | 241 | 74 |
| 323 | 4220 | 5152 | 2930 | 1547 | 888 | 931 | 0.93 | 0.67 | 0.33 | 0.34 | 4 | 1 | 51 | 20 |
| 325 | 26673 | 12400 | 16598 | 4879 | 2703 | 1464 | 54 | 14 | 14 | 3 | 50 | 56 | 1603 | 229 |
| 328 | 8118 | 7073 | 1216 | 1268 | 1216 | 1268 | 7.5 | 5.5 | 0.29 | 0.21 | 99 | 81 | 94 | 66 |
| 352 | 19958 | 6525 | 5585 | 1064 | 2614 | 1731 | 43 | 11 | 0.84 | 0.22 | 17 | 16 | 519 | 33 |
| 353 | 23981 | 13736 | 6807 | 2062 | 9230 | 3637 | 58 | 20 | 0.83 | 0.22 | 68 | 51 | 855 | 222 |
| 393* | 8729 | 5150 | 13320 | 1974 | 1075 | 892 | 14 | 6.1 | 2.5 | 0.27 | 13 | 51 | 715 | 144 |
| 394 | 22856 | 12823 | 6178 | 1909 | 1009 | 1131 | 96 | 35 | 1.1 | 0.34 | 59 | 69 | 1281 | 282 |
| 401 | 31108 | 19746 | 1677 | 1336 | 1677 | 1336 | 94 | 34 | 4.8 | 0.4 | 89 | 116 | 1098 | 134 |

TABLE 2-continued

Individual participant characteristics

| | | | | | | | | | | | | | | |
|---|---|---|---|---|---|---|---|---|---|---|---|---|---|---|
| 403* | 24462 | 13614 | 4060 | 3187 | 2107 | 1164 | 170 | 29 | 0.7 | 0.13 | 29 | 41 | 3888 | 179 |
| 410 | 6355 | 4353 | 2456 | 1730 | 1249 | 1112 | 2.8 | 1.3 | 0.36 | 0.29 | 25 | 19 | 222 | 65 |
| 437 | 15987 | 6834 | 3051 | 1940 | 3051 | 1940 | 16 | 6.3 | 0.89 | 0.23 | 146 | 75 | 699 | 176 |
| 461 | 17491 | 13418 | 6867 | 1946 | 1827 | 1454 | 38 | 44 | 2 | 0.46 | 73 | 182 | 1077 | 361 |
| 470 | 6054 | 4894 | 2315 | 1798 | 1003 | 1025 | 5.3 | 3.1 | 0.2 | 0.16 | 90 | 86 | 50 | 14 |
| 478 | 6600 | 4083 | 3238 | 1824 | 1264 | 1283 | 7.1 | 3.3 | 1.8 | 0.24 | 33 | 41 | 263 | 15 |
| 500 | 6039 | 5366 | 2254 | 2305 | 2356 | 2412 | 4.2 | 1.6 | 0.57 | 0.2 | 26 | 16 | 194 | 36 |
| 501* | 22775 | 8667 | 5272 | 1242 | 1557 | 1098 | N/A | N/A | N/A | N/A | N/A | N/A | 719 | 125 |
| 506 | 3036 | 2595 | 1205 | 975 | 1338 | 1041 | N/A | N/A | N/A | N/A | N/A | N/A | 10 | 10 |
| 507 | 15458 | 7586 | 4505 | 989 | 1208 | 1218 | 22 | 13 | 0.88 | 0.36 | 104 | 90 | 400 | 49 |
| 509 | 9217 | 5538 | 2930 | 1258 | 1286 | 1417 | 11 | 4.5 | 0.41 | 0.18 | 165 | 189 | 236 | 36 |
| 537 | 11285 | 6443 | 2448 | 1083 | 1245 | 1192 | 13 | 8.6 | 0.56 | 0.23 | 89 | 52 | 923 | 986 |
| 539* | 20337 | 9568 | 7505 | 1386 | 1714 | 2124 | 68 | 41 | 1 | 0.65 | 144 | 199 | 488 | 50 |
| 547* | 28228 | 15394 | 3863 | 2048 | 3863 | 2048 | 73 | 33 | 9.1 | 0.22 | 66 | 140 | 2901 | 211 |
| 632 | 16796 | 9152 | 1766 | 1548 | 2415 | 1833 | 31 | 12 | 0.36 | 0.25 | 141 | 153 | 572 | 161 |
| 633 | 8759 | 5108 | 1436 | 1224 | 2019 | 1404 | 4.8 | 3.3 | 0.25 | 0.26 | 121 | 157 | 135 | 32 |
| 652* | 25025 | 7388 | 2748 | 1433 | 2748 | 1433 | 112 | 27 | 1 | 0.18 | 79 | 73 | 2324 | 275 |
| 664* | 12698 | 6927 | 3357 | 1420 | 1440 | 1395 | 11 | 4 | 0.43 | 0.21 | 61 | 26 | 384 | 37 |
| 674* | 36682 | 21702 | 3061 | 1141 | 1320 | 1218 | 251 | 57 | 0.4 | 0.13 | 45 | 66 | 1619 | 298 |

*= hospitalized,

**= asymptomatic

§ = Arterial hypertension (HTN), obesity (OB), diabetes mellitus (DM), asthma (A), chronic obstructive pulmonary disease (COPD), coronary artery disease (CAD), cancer (CX)

¶ = WHO Ordinal Scale for Clinical Improvement, COVID-19 Trial Design Synopsis

† = Persistent fatigue, dyspnea, athletic deficit, or ≥3 other solicited symptoms beyond 6 weeks from Sx onset Reported data are median (range) unless stated otherwise Antibody reactivity in plasma to RBD and nucleoprotein (N) in plasma was measured by validated serological assays (Robbiani, D. F. et al. Nature 584, 437-442). Two anti-RBD assays were strongly correlated (anti-RBD IgG and IgM ELISA/Pylon-IgG and IgM at 1.3 months, r=0.9200 and r=0.7543, p<0.0001, respectively.). The IgM, IgG, and IgA anti-RBD antibodies in plasma decreased significantly between 1.3 and 6.2 months (FIGS. 1*a*-*c*). However, the drop in RBD-binding activity differed significantly by isotype, IgM showed the greatest decrease in anti-RBD reactivity (53%), followed by IgG (33%), while IgA decreased by only 15% (FIG. 1*e*). In all cases, the magnitude of the decrease was inversely proportional to and directly correlated with the initial antibody levels such that individuals with higher initial levels showed greater relative changes (FIGS. 1*f*-*i*). In contrast, the Roche anti-N assay showed a small but significant increase (19%) in reactivity between the 2 time points that did not correlate with IgA anti-RBD ELISAs and was modestly correlated with IgM at 1.3 months and IgG anti-RBD reactivity at both time points, respectively (FIG. 1*d*). Notably, individuals with persistent post-acute symptoms had significantly higher anti-RBD IgG and anti-N antibody levels at both study visits.

Plasma neutralizing activity was measured using an HIV-1 virus pseudotyped with the SARS-CoV-2 spike protein. The geometric mean half-maximal neutralizing titer ($NT_{50}$) in this group of 87 participants was 401 and 78 at 1.3 and 6.2 months, respectively, representing a five-fold decrease (FIGS. 1*j*-*k*). Neutralizing activity was directly correlated with the IgG anti-RBD ELISA measurements. Moreover, the absolute magnitude of the decrease in neutralizing activity was inversely proportional to and directly correlated with the neutralizing activity at the earlier time point (FIG. 1*l*). We conclude that antibodies to RBD and plasma neutralizing activity decrease significantly but remain detectable 6 months after infection with SARS-CoV-2 in the majority of individuals.

Whereas plasma cells are the source of circulating antibodies, memory B cells contribute to recall responses. To identify and enumerate the circulating SARS-CoV-2 memory B cell compartment, we used flow cytometry to isolate individual B lymphocytes with receptors that bound to RBD (FIGS. 2*a*-*b* and FIG. 6). Notably, the percentage of RBD-binding memory B cells increased marginally between 1.3 and 6.2 months in 21 randomly selected individuals (FIG. 2*b*).

Figures 7A, 7B:
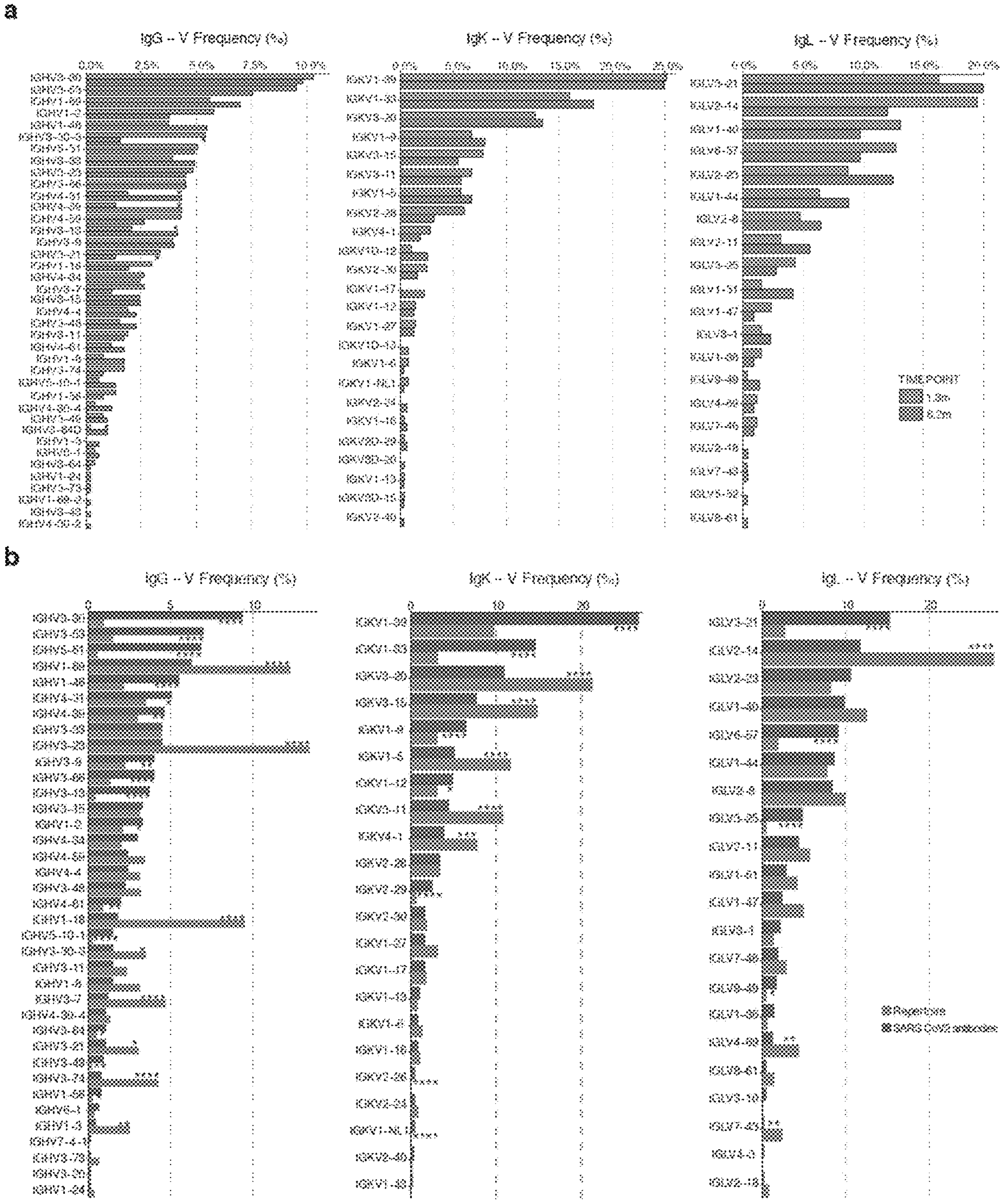
FIGS. 7*a* and 7*b* show frequency distributions of human V genes.
Figures 9E, 9F:
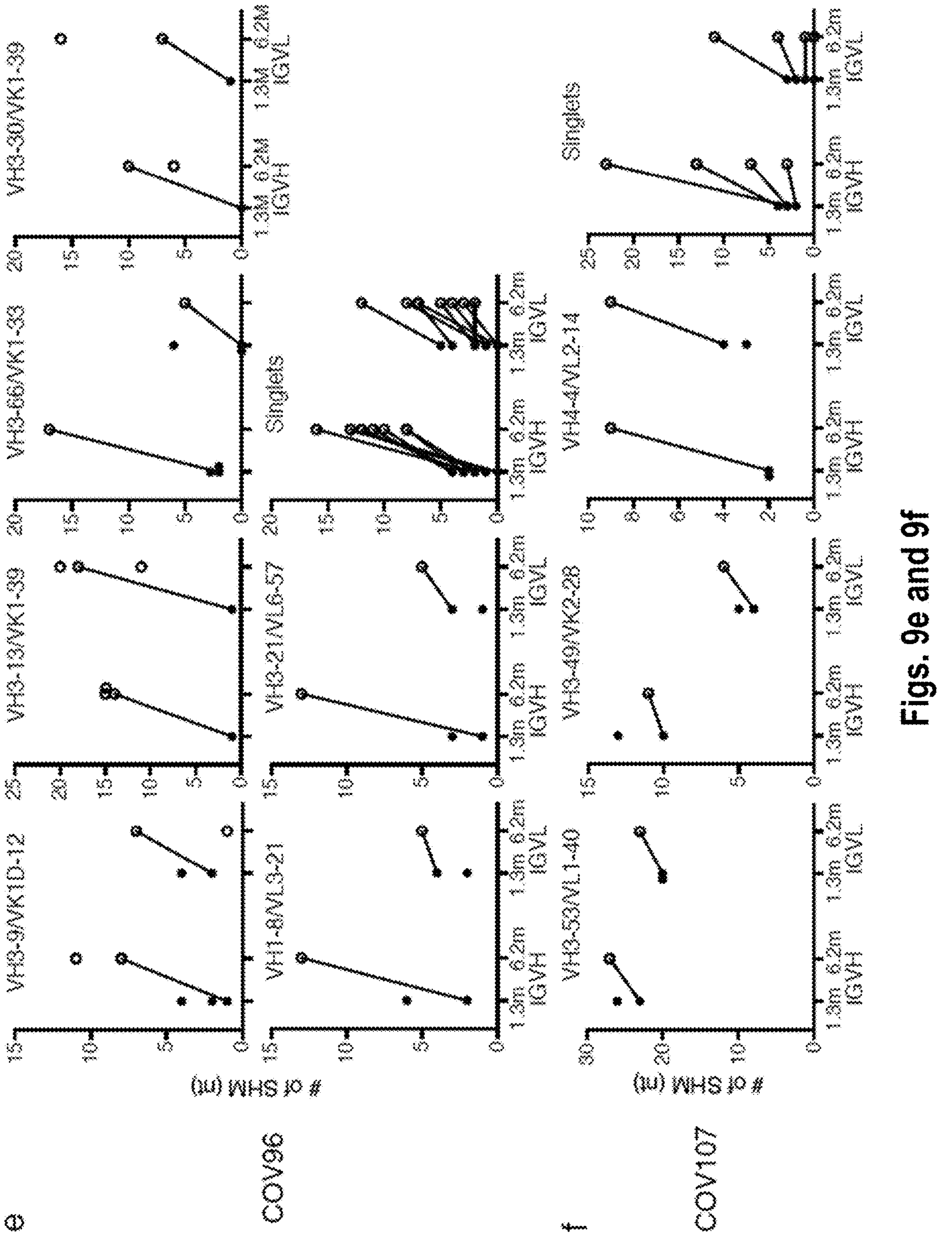
Figure 10A:
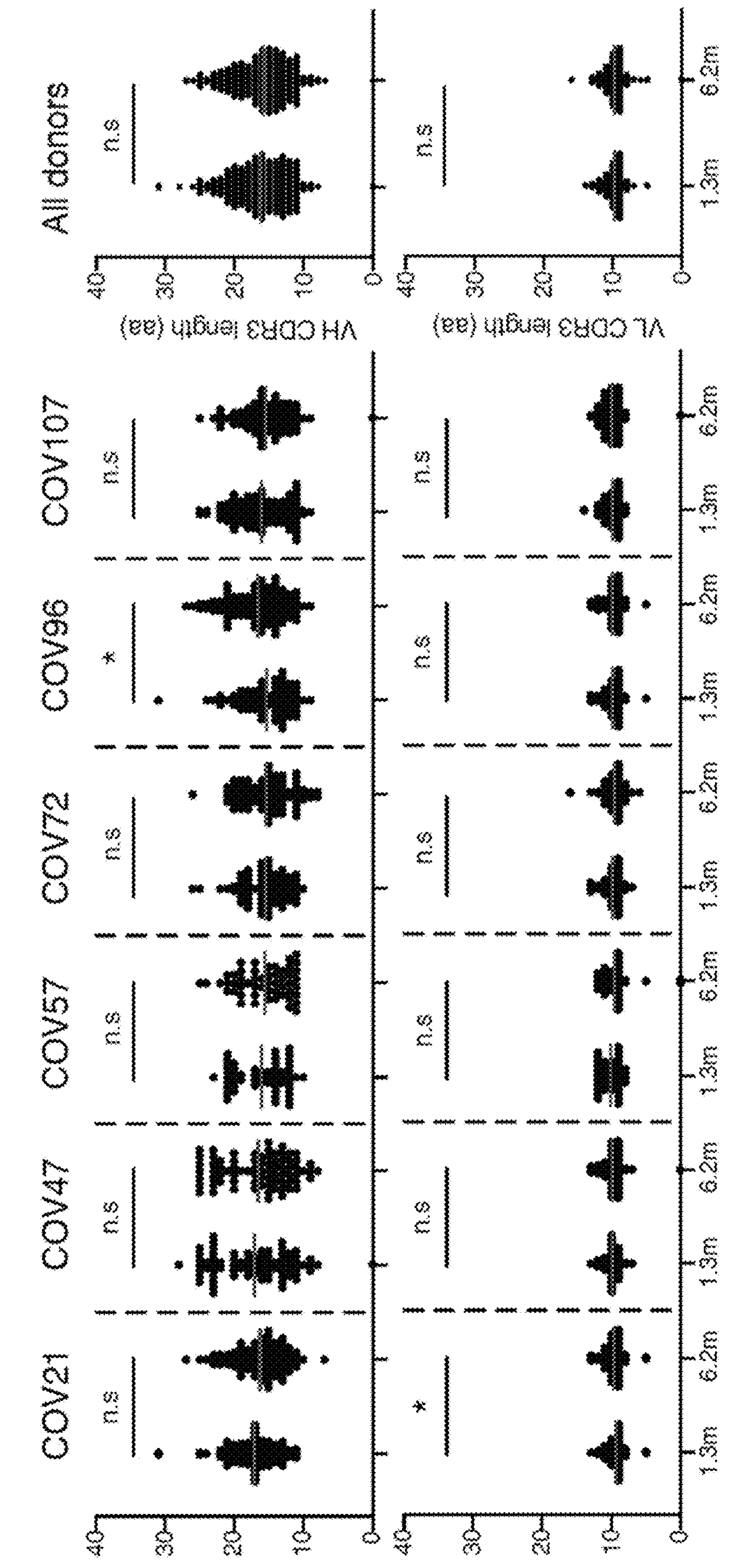
FIGS. 10*a* and 10*b* show the analysis of CDR3 length and hydrophobicity.
Figure 10B:
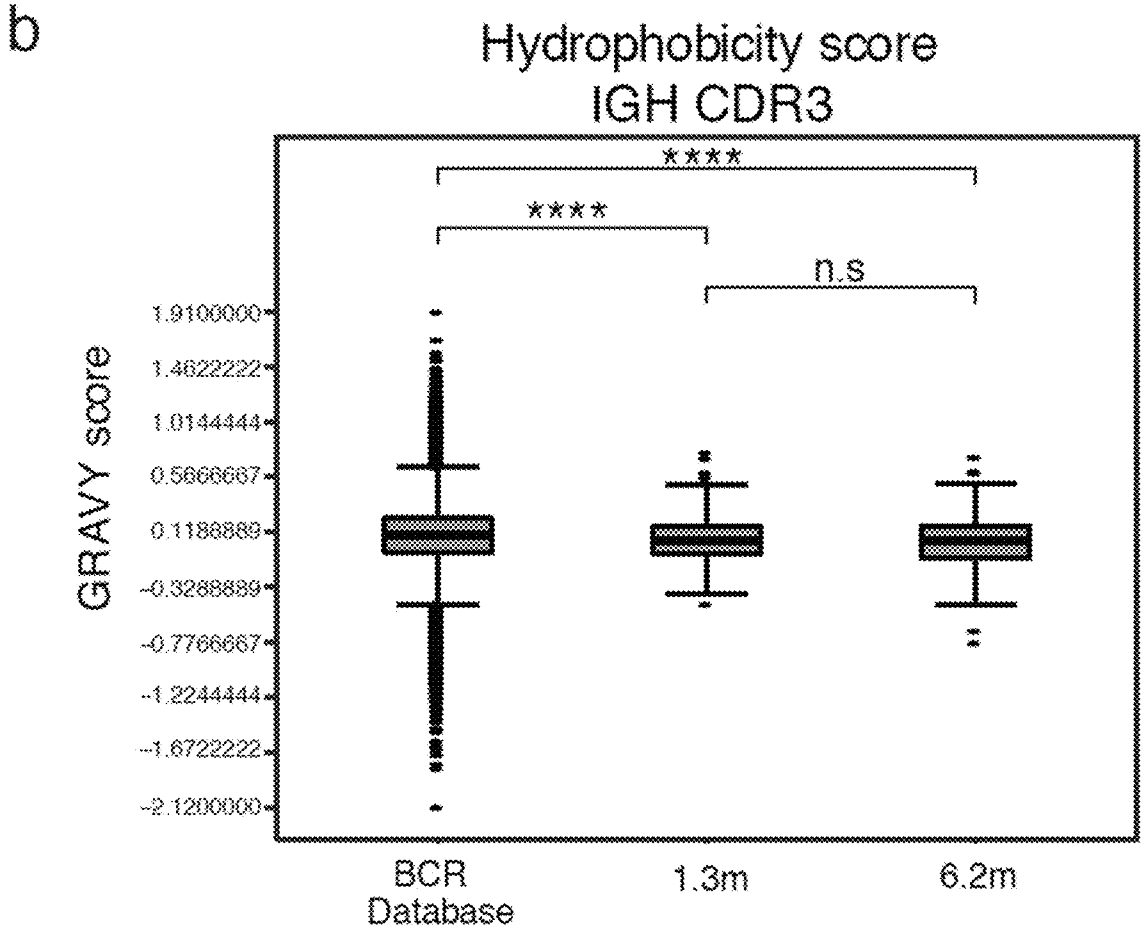
Figure 13A:
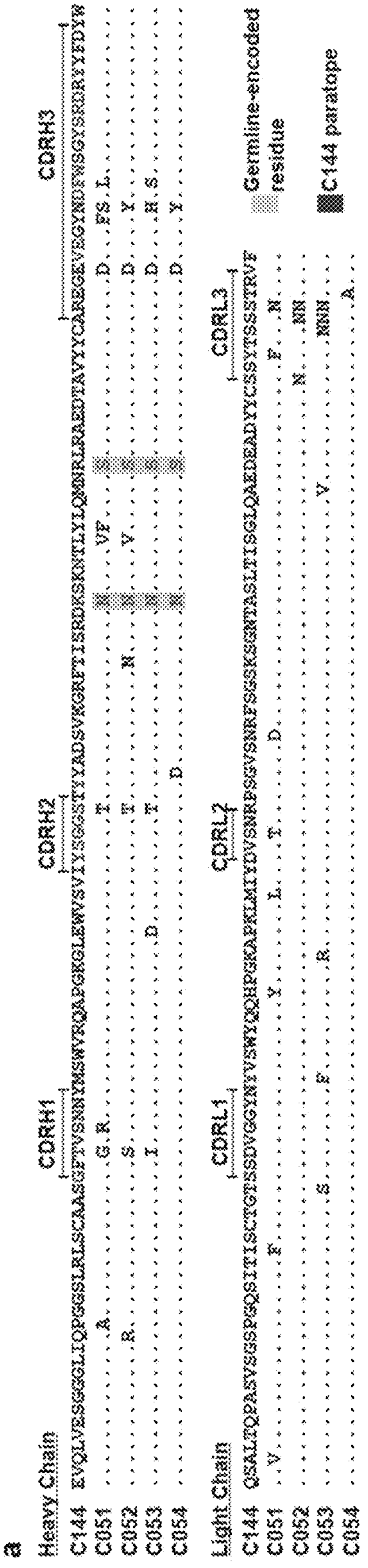
Figures 15A, 15B:
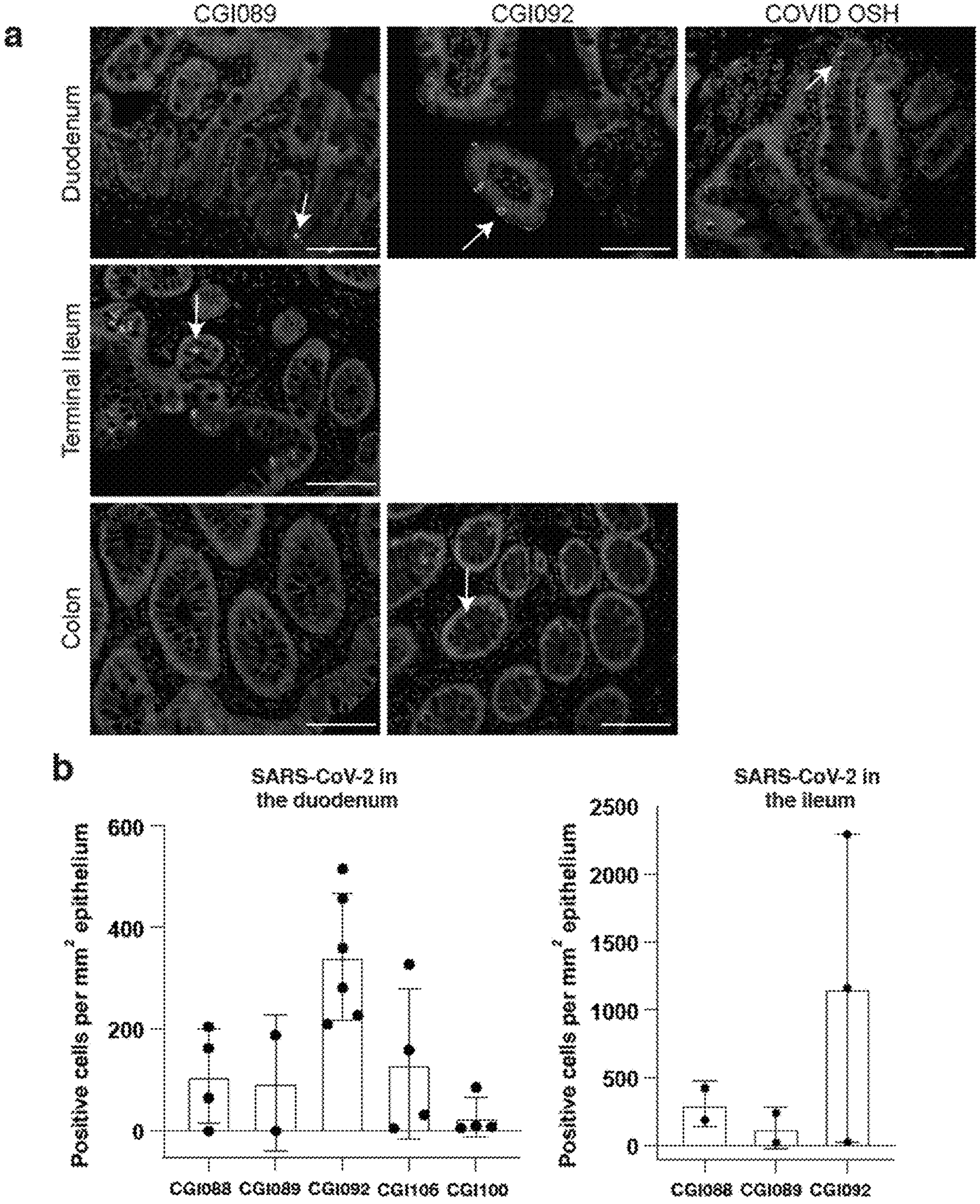
FIGS. 15*a* and 15*b* show that SARS-CoV-2 antigen is detectable in different intestinal segments in multiple COVID-19 convalescent individuals.
Figure 16:
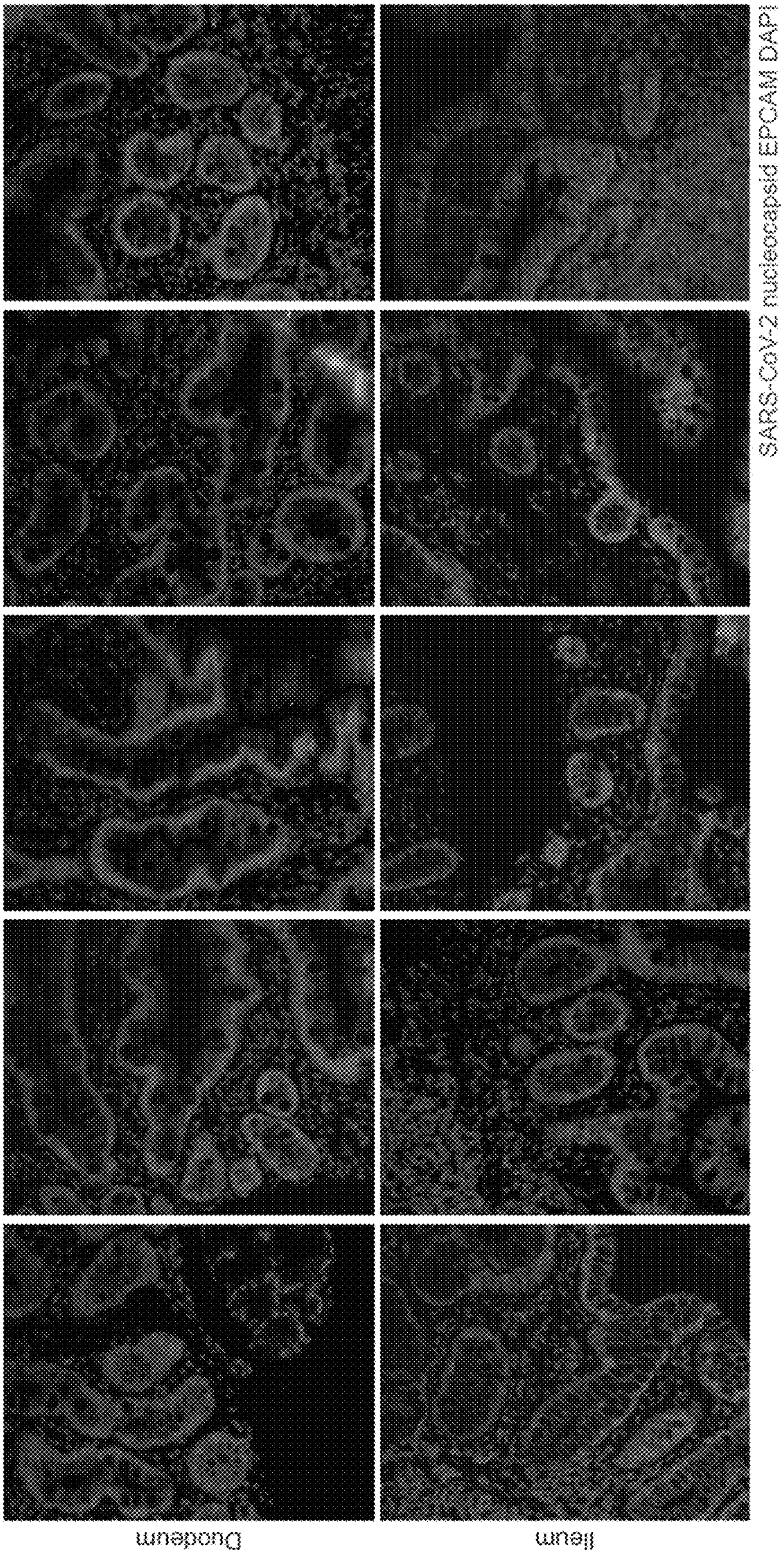
FIG. 16 shows that COVID-19 negative individuals show no detectable SARS-CoV-2 antigen by immunofluorescence (IF) images of biopsy samples along the gastrointestinal tract obtained from 10 different individuals with no history of COVID-19 are shown. Staining is for EPCAM, DAPI, and SARS-CoV-2 nucleocapsid.

To determine whether there were changes in the antibodies produced by memory B cells after 6.2 months, we obtained 532 paired antibody heavy and light chains from the same 6 individuals that were examined at the earlier time point (Table 9). There was no significant difference in IGV gene representation at the two time points, including the over-representation of the IGHV3-30 and 3-53 gene segments (FIG. 7). In keeping with this observation, and similar to the earlier time point, antibodies that shared the same IGHV and IGLV genes comprised 8.6% of all sequences in different individuals (FIG. 13*a*). As might be expected, there was a small but significant overall increase in the percentage of IgG-expressing anti-RBD memory cells, from 47% to 57% (p=0.011, FIGS. 13*b*-*d*). Consistent with the fractional increase in IgG memory cells, the extent of somatic hypermutation for both IGH and IGL differed significantly in all 6 individuals between the two time points. Whereas the average number of nucleotide mutations in IGH and IGL was only 4.2 and 2.8 at the first time point, these values were increased to 11.7 and 6.5 at the second time point (p<0.0001, FIG. 2*c* and FIG. 9). In contrast, the overall average IGH and IGL CDR3 length and hydrophobicity were unchanged (FIG. 10).

Similar to the earlier time point, it was found expanded clones of memory B cells at 6.2 months including 23 that appeared at both time points. However, expanded clones accounted for only 12.4% of all antibody sequences after 6.2 months compared to 32% after 1.3 months (p=0.0225, FIG. 2*d*). In addition, the overall clonal composition of the memory compartment differed at the two time points in all individuals examined (FIG. 2*d*). Forty-three expanded clones that were present at the earlier time point were not detectable after 6.2 months, while 22 new expanded clones appeared. In addition, the relative distribution of clones that appeared at both time points also varied. For example, the dominant clones in COV21 and COV57, representing 9.0% and 16.7% of all sequences, respectively, were reduced to 1.1% and 1.9% of all sequences after 6.2 months (FIG. 3*d*). It was concluded that while the magnitude of the RBD-specific memory B cell compartment is conserved between 1.3 and 6.2 months after SARS-CoV-2 infection, there is significant clonal turnover and antibody sequence evolution, consistent with prolonged germinal center reactions.

One hundred and twenty-two representative antibodies from the 6.2-month time point were tested for reactivity to RBD (Table 4). The antibodies that were evaluated included: (1) 49 that were randomly selected from those that appeared only once; (2) 23 that appeared as singles at both 1.3 and 6.2 months; (3) 23 representatives of newly appearing expanded clones; (4) 27 representatives of expanded clones appearing at both time points. One hundred and fifteen of 122 of the antibodies bound to RBD, indicating that flow cytometry efficiently identified B cells producing anti-RBD antibodies (FIG. 3*a* and Table 4). Taking all antibodies together, the mean $EC_{50}$ was not significantly different at the two time points (FIG. 3*a*, Table 4). However, a comparison of the antibodies that were present at both time points revealed a significant improvement of the $EC_{50}$ after 6.2 months (p=0.0227, FIG. 3*b* and FIG. 11*a*).

TABLE 4A

Sequences of cloned recombinant antibodies

| Patient ID | Antibody ID | Time point | SEQ ID NO | IGH VDJ (aa) | SEQ ID NO | IGL VJ (aa) |
|---|---|---|---|---|---|---|
| COV47 | C050 | 6.2 m | 1 | EVQLVESGGGLFQPGGSLRLSCAASGFSVRNNYVSWVRQAPGKGLEWVSVIYSGGTTYYADSVKGRFTISRDISENTLYLQMNSLRAEDTAVYYCAREGDVEGLHDFWSGYSRDRYYFDYWGQGTLVTVSS | 2 | QSALTQPASVSGSPGQSIIISCTGTSGDIGGYNYVSWYQQHPGKAPKLMIYDVSFRPSGVSNRFSGSKSDNTASLTISGLQAEDEADYYCSSFTGNNTRVFGTGTKVTVL |
| | C051 | 6.2 m | 3 | EVQLVESGGGLIQAGGSLRLSCAASGFGVRNNYMSWVRQAPGKGLEWVSVIYSGGTTYYADSVKGRFTISRDNSKNTVFLQMNSLRAEDTAVYYCAREGDVEGFSDLWSGYSRDRYYFDYWGQGTLVTVSS | 4 | QSALTQPASVSGSPGQSITFSCTGTSSDVGGYNYVSWYQQYPGKAPKLLIYDVTNRPSGVSDRFSGSKSGNTASLTISGLQAEDEADYYCSSFTSSNTRVFGTGTKVTVL |
| | C052 | 6.2 m | 5 | EVQLVESGGGLIRPGGSLRLSCAASGFSVSNNYMSWVRQAPGKGLEWVSVIYSGGTTYYADSVKGRFNISRDNSKNTVYLQMNSLRAEDTAVYYCAREGDVEGYYDFWSGYSRDRYYFDYWGQGALVTVSS | 6 | QSALTQPASVSGSPGQSITISCTGTSSDVGGYNYVSWYQQHPGKAPKLMIYDVSNRPSGVSNRFSGSKSGNTASLTISGLQAEDEADYYCNSYTSNNTRVFGTGTKVTVL |
| | C053 | 6.2 m | 7 | EVQLVESGGGLIQPGGSLRLSCAASGFIVSNNYMSWVRQAPGKGLDWVSVIYSGGTTYYADSVKGRFTISRDNSKNTLYLQMNSLRAEDTAVYYCAREGDVEGYHDSWSGYSRDRYYFDYWGQGTLVTVSS | 8 | QSALTQPASVSGSPGQSITISCTGSSSDVGGYNFVSWYQQHPGRAPKLMIYDVSNRPSGVSNRFSGSKSGNTASLTISGLQVEDEADYYCSSYTNNNTRVFGTGTKVTVL |
| | C054 | 6.2 m | 9 | EVQLVESGGGLIQPGGSLRLSCAASGFTVSNNYMSWVRQAPGKGLEWVSVIYSGGSTYDADSVKGRFTISRDNSKNTLYLQMNSLSAEDTAVYYCAREGDVEGYYDFWSGYSRDRYYFDYWGQGTLVTVSS | 10 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSARVFGTGTKVTVL |
| | C055 | 6.2 m | 11 | EVQLVESGGGLVQPGGSLRLSCAASGFSVSTKYMTWVRQAPGKGLEWVSVLYSGRTDYYADSVKGRFTISRDSSKNILYLQMSSLRVEDTGFYYCARDSSEVRDHPGHPGRSVGAFDIWSQGTMVTVSS | 12 | QSALTQPASVSGSPGQSIAISCTGTSNDVGSYTLVSWYQQYPGKAPKLLIFEDSQRSSGISNRFSGSKSGNTASLTISGLRGEDEADYYCCSYAGSHTFVFGGGTKVTVL |
| | C057 | 6.2 m | 13 | QVQLVQSGAEVKRPGASVKLSCKASGYIFTDYSIHWVRQAPGQGLEWMGWVNPNSGGGNSAQKFMDWVTMARDTSITTVYMELSRLRSDDTAVYYCARGPLFHKLVYDSWSGYHDGFDIWGQGTMVTVSS | 14 | QSALTQPASVSGSPGQSITISCTGTSSDVGAYKFVSWYQQHPGKAPQLIIYEVSNRPSGVSNRFSGSKSGNTASLTISGLQAEDEADYYCSSYTNASTWVFGGGTELTVL |
| | C058 | 1.3 m | 15 | QVQLVQSGAEVKKPGASVKVSCKASGYIFTDYSMHWVRQAPGQGLEWIGWVNPNSGGTNYAQKFQGWVTMARDTSITTVYMELSRLKSDDTAVYFCARGPLFHRLVYDFWSGYHDGFDMWGQGTMVTVSS | 16 | QSALTQPASVSGSPGQSITISCTGTSSDVGGYKFVSWYQQHPGKAPKLMIYEVSNRPSGVSNRFSGSKSGNTASLTISGLQAEDEADYYCNSYTSSSTWVFGGGTKLTVL |
| | C059 | 6.2 m | 17 | QVQLVQSGAEVKKPGASIKVSCKASGYTFTDYSIVIRWVRQAPGQGLEWMGWINPNSGGTKYAQKFQGWVTMTRDMSITTVYMELTRLRSDATAVFYCARGPLFHKLVYDSWTGYHDGFDIWGQGTMVTVSS | 18 | QSALTQPASVSGSPGQSITISCTGTSSDVGGYNYVSWYQHYPGKAPKLMIYEVTHRPSGVSNRFSGSKSGNTASLTISGLQAEDEADYYCSSSTNSSTWVFGGGTKMTVL |
| | C060 | 6.2 m | 19 | EVQLVESGGGLVQPGGSQRLSCAASGFTVSSNYMSWIRQAPGKGLEWVSVIYSGGSAYYVDSVKGRFTISRDNSKNTLYLQMNSLRPEDTAVYYCARIANYMDVWGKGTTVTVSS | 20 | EIVMTQSPATLSVSPGERATLSCRASQSVSSHLAWYQQKPGQAPRLLIYGASTRATGIPTRFSGSGSGTEFTLTISSLQSEDFAVYYCQQYNNWPPLTFGGGTKVEIK |
| | C062 | 6.2 m | 21 | EVQLVESGGGLVKPGGSLRLTCAASGFTFSTYSMNWVRQAPGKGLEWVSSISSSSSYIYYADSVKGRFTISRDNAKNSLYLQMNSLRAEDTAVYYCARERGYYGGKTPPFLGGQGTLVTVSS | 22 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNYWVFGGGTKLTVL |

TABLE 4A-continued

Sequences of cloned recombinant antibodies

| Patient ID | Antibody ID | Time point | SEQ ID NO | IGH VDJ (aa) | SEQ ID NO | IGL VJ (aa) |
|---|---|---|---|---|---|---|
| | C063 | 6.2 m | 23 | EVQLVQSGAEVKKPGDSLKISCKASGYSFTRYWIGWVRQMPGKGLDWMGIIYPGDSDTRYSSSFQGQVTISADKSISTAYLQWSSLKASDTSLYYCVRRASSTNFEFWGQGTLVTVSS | 24 | SYELTQPPSVSVAPGQTATITCGGNNIGSKTVHWYQQKPGQAPVVVVYDDSDRPSGIPERFSGSKSGSTATLTITRVEAGDEADYYCQVWDSTSDHYVFGTGTKVAVI |
| | C064 | 6.2 m | 25 | EVQLLESGGDLVQPGGSLRLSCAASGFTFSNYAMSWVRQAPGKGLEWVSAISGSGGNTYYADSVKGRFTISRDNSKNTLYLQMNSLRAEDTAVYYCAKAVHYGGNSDRRFSEPSAPFDYWGQGTLVTVSS | 26 | QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTPYVFGTGTKVTVL |
| | C065 | 6.2 m | 27 | QVQLQESGPGLVKPSQTLSLTCTVSGGSISSSNYYWSWIRQHPGKGLEWIGYIDYSGGTYYNPSLKSRVTISVDTSKNQFSLKLSSVTAADTAVYYCARVSTTVTTYLVGGFDIWGQGTMVTVSS | 28 | IRMTQSPSSLSASVGDRVTITCQASQDITNYLNWYQQKPGKAPKLLLYDASNLETGVPSRFSGSGSGTDFTFTISSLQPEDIATYYCQQYDNLPWTFGQGTKVEIK |
| | C066 | 6.2 m | 29 | EVQLVESGGGLIQPGGSLRLSCAASGLLVSRNYMTWVRQAPGKGLEWVSVIYSGGSTFYADSVRGRFTISRDNSKNTLYLQMDSLRAEDTAVYYCARDVGDYYGMDVWGQGTTVTVSS | 30 | DIQLTQSPAFLSASVGDRVTITCRASQGMSNYLAWYQQKPGKAPNLLIYTASTLQSGVPSRFSGSGSGTEFTLTISSLQPEDFATYYCQLLNSYPQLTFGGGTKVEIK |
| | C067 | 6.2 m | 31 | VQLVESGGGVVQPGRSLRLSCAASGFSFRIFGMNWVRQAPGKGLDWVAGISHDGSDKYFADSVKGRFTISRDNSKNTLYLQMNSLRADDTAVYYCARDMEVDYYDRSGHYHVFHAFDIWGQGTMVTVSS | 32 | DIVMTQSPDSLAVSLGARATINCKSSQSILYSSDNKSSLAWYQQKPGHPPKLLIYWASTRESGVPDRFSGSESGTDFTLTISNLQGEDVAVYYCQQYYSIPRSFGQGTKLEIK |
| | C068 | 6.2 m | 33 | QVQLVESGGGVVQPGRSLRLSCVASGFSFSTYGMHWVRQAPGKGLEWVALIWSDGSNKYYGDAAEGRFTISRDNSNNTLYLQMNNLRAEDTALYYCARDHSSSSFVYYYYMDVWGKGTTVTVSS | 34 | QSALTQPRSVSGSPGQSVTISCTGTSSDIGGYNYVSWYQQHPDKAPKFIIFDVSKRPSGVPDRFSGSKSGNTASLTISGLQAEDEADYYCCSYAGPYPYVFGTGTKVTVL |
| | C069 | 6.2 m | 35 | QVQLVQSGAEVKKPGSSVNVSCKASGGTFSTYAIHWVRQAPGQGLEWMGGIIPLFHTANYAQKFQGRVTITADESTSTAYMELSSLRSEDTAMYYCAINTQWDLVPRWGRGTLVTVSS | 36 | EIVLTQSPGTLSLAPGERATLSCRASQSVNSNYLAWYQQKPGQAPRLLIYGASSRATGIPDRFSGSGSGTDFTLTISRLEPEDFAVYYCQQYGFSLYSFGQGTKLEIK |
| | C081 | 1.3 m | 37 | EVQLVESGGGLVKPGGSLRLSCAASGFTFSSAWMSWVRQAPGKGLEWVGRIKTKTDGGTKDYAAPVKGRFTISRDDSKNTLYLQMNSLKTEDTAVYYCTTTNDYGDYSPAYWGQGTLVTVSS | 38 | DIQLTQSPSSLSASVGDRVTITCRASQSISSYLNWYQQKPGKAPKLLIYAASSLQSGVPSRFSGSGSGTAFTLTISSLQPEDFATYYCQQSYSTPLTFGGGTKVEIK |
| | C083 | 1.3 m | 39 | EVQLVESGGGLVKPGGSLRLSCAASGFTFSSYSMNWVRQAPGKGLEWVSSISSSTSYIYYADSVKGRFTISRDNAKNSLYLQMNSLRAEDTAVYYCARERYGDNWGQGTLVTVSS | 40 | QLVLTQSPSASASLGASVKLTCTLSSGHSSYAIAWHQQQPEKGPRYLMSLNSDGSHSKGDGIPDRFSGSSSGAERYLTISSLQSEDEADYYCQTWGPWVFGGGTKLTVL |
| | C085 | 1.3 m | 41 | QVQLQESGPGLVKPSETLSLTCTVSGDSMSSYFWTWIRQPPGKGLECIGYFYPSGSTNYNPSLKSRVTISIDTSKNQFSLKLSSVTAADTAVYYCARLKQQLVGFGWFDPWGQGTLVTVSS | 42 | QSVLTQPPSVSGAPGQRVTISCTGSSSNIGADYDVHWYQQFPGTAPKVLIYANTNRPSGVPERFSGSKSGTSASLAITGLQAEDEADYYCQSYDHSLNWVFGGGTKLTVL |
| | C086 | 6.2 m | 43 | QVQLQESGPGLVKPSETLSLTCTVSGDSISTYFWAWIRQPPGRGLECIGSFFPSGSTYYNPSLKSRVTISVDTSKNQFSLKLNSVTAADTAVYYCARLKQQLVGFGWFDPWGQGSLVTVSS | 44 | QSVLTQPPSVSGAPGQRVTISCTGSISNIGADYEVHWYVQFPGTAPKVLIYANTNRPSGVPERFSASKSGTSASLAITGLQAEDEADYYCQSYDHRLHWVFGGGTKLTVL |

TABLE 4A-continued

Sequences of cloned recombinant antibodies

| Patient ID | Antibody ID | Time point | SEQ ID NO | IGH VDJ (aa) | SEQ ID NO | IGL VJ (aa) |
|---|---|---|---|---|---|---|
| | C088 | 6.2 m | 45 | QVQLVQSGAEAKKPGASVKVSCKTSGYTFTNYFMHWVRQAPGQGPEWMGIIDSSDGGASYAQKFQGRVTMTRDTSTSTVYMELRSLKFEDTAVYYCARASTSTTSWSDALSLGSWGQGTLVTVSS | 46 | QSVLTQPPSVSGAPGQRVTISCTGSSSNIGGGSVVHWYQQLPGTAPKLLIYANSNRPSGVPDRFSGSKSGTSASLAIAGLQAEDEADYYCQSWDNGLSASGVVFGGGTKLTVL |
| | C089 | 1.3 m | 47 | QVQLVESGGGVVQPGRSLRLSCAASGFTFRTYAMHWVRQAPGKGLEWVAVILSDGNNKYYADSVKGRFTISRDNSKNTLYLQMNSLRAEDTAIFYCAREQEANYYDISGYYHWGESLGYWGQGTLVTVSS | 48 | DIQLTQSPSFLSASVGDRVTITCRASQGISSYLAWYQQKPGKAPKLLIYGASTLQSGVPSRFSGSGSGTEFTLTISSLQPEDFASYYCQKVNSHPPGLTFGGGTKVEIK |
| | C090 | 6.2 m | 49 | QVQLVESGGGVVQPGRSLRLSCAASGFTFRTYAMHWVRQAPGKGLEWVAVILSDGNNKYYADSVKGRFTISRDNSKNTLYLQMNSLRAEDTAIFYCAREQEANYYDISGYYHWGESLGYWGQGTLVTVSS | 50 | DIQLTQSPSFLSASVGDRVTITCRASQGISSYLAWYQQKPGKAPKFLIYGASTLQSGVPSRFSGSGSGTEFTLTISSLQPEDFASYYCQKVNSYPPGLTFGGGTKVEIK |
| | C518 | 6.2 m | 51 | EVQLVESGGGLIQPGGSLRLSCAASGITVSSNYMSWVRQAPGKGLEWVSVMYAGGSSFYADSVKGRFTISRDNSKNTLYLQMNSLRVEDTAVYYCARDLIALGVDVWGQGTTVTVSS | 52 | DIQLTQSPSFLSASVGDRVTITCRASQGISSYLAWYQQKPGKAPKLLIYAASTLQSGVPSRFSGSGSGTEFTLTISSLQPEDFATYYCQLLNSYPMCSFGQGTKLEIK |
| | C519 | 6.2 m | 53 | QVQLQESGPGLVKPSETLSLTCAVSGGSISSYYWSWIRQPPGKGLEWIGYIDTSGSTNYNPSLKSRVTMSVDTSKNQFSLNVNSVTAADTAVYFCGVCAGDCYAASVFDYRGQGTLVTVSS | 54 | DIQMTQSPSSLSASVGDRVTITCQASQDIIFYLNWYQQKPGKAPKLLIYDASNLKTGVPSRFSGSGSGTDFAFTISSLQPEDIATYYCQQYDNLPLTFGGGTKVEIK |
| COV72 | C501 | 6.2 m | 55 | QVQLVQSGPEVKKPGTSVKVSCKASGFTFGSSAVQWVRQARGQRLEWIGWIVVGSGNTDYAQRFQERVTITRDMSTNTVYMELSSLRFEDTAVYYCAAVYCSGTTCHDAFDIWGRGTMVTVSS | 56 | DIQMTQSPCSLSASVGDRVTITCQATQDIRKYLNWFRRKLEKAPKLLIYDASTLDTRVPSRFSGNRSATDFTFTICSLQPEDNARYSCQQSDTLPPLGGDTPDTFGHGTKLEIK |
| | C502 | 6.2 m | 57 | QVQLVQSGAEVKKPGSSVKVSCKASGDTFSSHAINWVRQAPGQGLEWMGRSIPMLGVTTSAQKFKGRVTITADHSTSTVFMDLSSLRSDDTAIYYCARGVVGATPGSFDLWGQGTMVTVSS | 58 | EIVMTQSPATLSVSPGKRATLSCRASQSVRSNLAWYQQRPGQAPRLLIYDAATRATGIPTRFSGSGSGTEFTLTISSLQSEDFAVYYCQQYDNGLTFGGGTKVEIK |
| | C503 | 6.2 m | 59 | QVQLQESGPGLVQPSGTLSLSCTVTGGSISSNNWWSWVRQSPVKGLEWIGEIYHNGNINYNPSLKSRVTMSIDKSKNHFSLKLSSVTAADTAVYYCARGDVLDWFDPWGQGTLVTVS | 60 | QSALTQPASVSGSPGQSITFSCTGTSSDVGAYNYISWYQQHPGKAPKLMIYDVNNRPSGVSRRFSGSKSGNTASLTISGLQSEDEADYFCSSYAGNSTVRFGGGTKLTVL |
| | C504 | 6.2 m | 61 | QVQLQESGPGLVKPSETLSLTCTVSGGSISSSYWNWIRQSPGKGLEWIGYIYYDGYTTFNPSLKSRVTISVDTSKNQFSLKLSSVTAADTAFYYCAAGLKGRSSSWYEYWGQGTLVTVSS | 62 | DIQMTQSPSSLSASVGDRVTITCRASQSISSYLNWYQQKPGKAPKLLIYATSSLQSGVPSRFSGSGSGTDFTLTITSLQPEDFATYYCQQTYSSPHTFGQGTKLEIK |
| | C505 | 6.2 m | 63 | EVQLLESGGGLVQPGGSLRLSCADSGFSFSTYGMSWVRQAPGKGLEWVSTISGSGDNTYHADSVKGRFTISRDNSKNTLYLQMNSLRAEDTAVYYCAKNIAEMSTFDDYFYYYGMDVWGQGTTVTVSS | 64 | SYELTQPPSVSVSPGQTASITCSGDKLGDKYACWYQQKPGQSPVMVIYQDTKRPSGIPERFSGSNSGNTATLTISGTQAMDEADYYCQAWDSSTFYVFGTGTKVTVL |
| | C506 | 6.2 m | 65 | EVQLVESGGGLVQPGGSLRLSCAASGFTFSSYDMHWVRQGTGKGLEWVSVIGTAGDAYYPGSVKGRFTISRENAKNSLYLQMNSLRAGDTAVYYCARMVYDSSGFKGYFDLWGRGTLVTVSS | 66 | DIQMTQSPSSLSASVGDRVTITCRASQSISSYLNWYQQKPGKAPKLLIYAASSLQSGVPSRFSGSGSGTDFTLTISNLQPEDFATYYCQQSYSTSMYTFGQGTKLEIK |

TABLE 4A-continued

Sequences of cloned recombinant antibodies

| Patient ID | Anti-body ID | Time point | SEQ ID NO | IGH VDJ (aa) | SEQ ID NO | IGL VJ (aa) |
|---|---|---|---|---|---|---|
| | C507 | 6.2 m | 67 | EVQLVESGGGVVQPGRSLRLSCAASGFTFSSYAIHWVRQAPGKGLEWVAVISFDGSNKYYRDSVKGRFTISRDNGKNTLYLQMNSLRAEDTAVYYCAKAALGYCTNGVCYCDNWGQGTLVTVSS | 68 | NFMLTQPHSVSESPGKTVTISCTGSSGSIASNYVQWYQQRPGSAPTTVIYEDNQRPSGVPDRFSGSIDSSSNSASLSISGLKTEDEADYYCQSYDINSLWVFGGGTRLTVL |
| | C508 | 6.2 m | 69 | QLQLQESGPGLVKPSETLSLTCTVSGASIRNSNYFWGWIRQPPGKGLQWIGSIYYSGSTSYNPSLRTRVTVSVDTSKNQFSLKLSSVTAADTAVYYCARPRAGGDSSFFWDSWGRGTLVTVSS | 70 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTMVFGGGTKLTVL |
| | C509 | 6.2 m | 71 | QVQLQESGPGLVKPSGTLSLTCAVSGGSISSSNWWSWVRQPPGKGLEWIGEIYNSGSTNYNPSLKSRVTILVDKSKNQFSLKLSSVTAADTAVYYCAGSYSNYIGGVWFDPWGQGTLVTVSS | 72 | EIVLTQSPATLSLSPGERATLSCRASQSVSTYLAWYQQKPGQAPRLLIYDASNRATGIPARFSGSGSGTDFTLTISSLEPEDFAVYYCQQRNNWLTFGGGTKVEIK |
| | C510 | 6.2 m | 73 | QVQLQQWGAGLLKPSETLSRTCAVYGGSFSGYYWSWFRQSPGKGLEWIGEINHSGSTNYNPSLKNRVTISVDTSKNQFSLMLSSVTAADTAVYYCARGGFGVVINYYYSGMDVWGRGTTVTVSS | 74 | DIVMTQSPLSLPVTPGEPASISCRSSQSLLHSNGYNYLDWYLQKSGQSPQLLIYLGSNRASGVPDRFSGSGSGTDFTLKISRVEAEDVGVYYCMQALQTPPTFGQGTKVEIK |
| | C511 | 6.2 m | 75 | EVQLVESGGGLVQPGGSLRLSCAATEITVSSNYMTWVRQAPGKGLEWVSVIYPGGSTFYADSVKGRFSISRDNSKNTLYLQMNSLRAEDTAVYYCARDLVVYGLDCWGQGTLVTVSSEVQLVESGGGLVQPGGSLRLSCAATEITVSSNYMTWVRQAPGKGLEWVSVIYPGGSTFYADSVKGRFSISRDNSKNTLYLQMNSLRAEDTAVYYCARDLVVYGLDCWGQGTLVTVSS | 76 | DIQLTQSPSFLSASVGDRVTITCRASQGISSYLAWYQQKPGKAPKLLIYAASTLQSGVPSRFSGSGSGTEFTLTISSLQPEDFATYYCQQLNTYPPPFGGGTKVEIK |
| | C512 | 6.2 m | 77 | QVQLQESGPGLVKPSGTLSLTCAVSAGSISSNNWWSWVRQPPGKGLEWIGEVYHNGNINYNPSLKSRVTLSVDKSKNQFSLKLSSVTAADTAVYYCAKGGDRAMGPEYFDSWGQGTLVTVSS | 78 | QSALTQPASVSGSPGQSITISCTGTSSDVGANNYVSWYQQHPGKAPKLMIYDVNERPSGVSNRFSGSKSGNTASLTISGLQTEDEADYYCSSFASSSTLLFGGGTKLTVL |
| | C513 | 6.2 m | 79 | EVQLLESGGGLVQPGGSLRLSCVASGFSFSTYAMSWVRQAPGQGLEWVSTITGTSIGTYYADSVKGRFTISRDNSKNTVFLQMKSLRAEDAAVYYCANHPLASGDEYYYYYMDVWGKGTTVTVSS | 80 | EIVLTQSPDTLSLSPGERATLSCRASQSVHSKQLAWYQQKPGQAPRLLIYGASSRATGIPDRFSGSGSGTDFTLTISRLEPEDFAVYYCQQYGSIRALTFGGGTKVEIK |
| | C514 | 6.2 m | 81 | EVQLVESGGGLVQPGGSLRLSCAASEFIVTRNYMSWVRQAPGKGLEWVSLIYPGGSTFYADSVKGRFTISRDNSKNTLFLHMNSLRAEDTAVYYCARDLAGRLDYWGQGTLVTVSS | 82 | DIQMTQSPSSLSASVGDRVTITCQASQDINNFLNWYQQKPGKAPKLLIYDASNLETGVPSRFSGSGSGTDFTFTISSLQPEDIAIYYCQQYDSLSRLTFGGGTKVEIK |
| | C515 | 1.3 m | 83 | EVQLVESGGGLVQPGGSLRLSCAASGFIVSSNYMSWVRQAPGKGLEWVSILYSGGSTYYADSVKGRFTISRDNSKNTLYLQMNSLRAEDTAVYYCARDLVVYGADYWGQGTLVTVSS | 84 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPPFGGGTKVEIK |
| | C516 | 1.3 m | 85 | QVQLVQSGAEVKKPGSSVKVSCKASGGTFSSYAISWVRQAPGQGLEWMGRIIPMLVIATYARKFQGRVTITADKSTSTAYMELSSLRSEDTAVYYCARGVVAATPGNFDIWGQGTMVTVSS | 86 | EIVMTQSPATLSVSPGERATLSCRASQSVSSNLAWYQQKPGQAPRLLIYGASTRATGIPARFSGSGSGTEFTLTISSLQSEDFAVYYCQQYNNGLTFGGGTKVEIK |
| | C517 | 1.3 m | 87 | EVQLVESGGGLVQPGGSLRLSCAASEFIVSRNYMSWVRQAPGKGLEWVSLIYSGGSTYYADSVKGRFTISRDNSKNTLYLQMNSLRAEDTAMYYCARDIAGRLDYWGQGTLVTVSS | 88 | DIQMTQSPSSLSASVGDRVTITCQASQDISKYLNWYQQKPGKAPKLLIYDASNLETGVPSRFSGSGSGTDFTFTISSLQPEDFATYYCQHYDSLSRLTFGGGTKVEIK |

TABLE 4A-continued

Sequences of cloned recombinant antibodies

| Patient ID | Antibody ID | Time point | SEQ ID NO | IGH VDJ (aa) | SEQ ID NO | IGL VJ (aa) |
|---|---|---|---|---|---|---|
| | C597 | 1.3 m | 89 | QVQLVQSGPEVKKPGTSVKVSCKASGFTFTNSAVQWVRQSRRQRLEWIGWIVVGSGNTNYAQKFQERVTITRDMSTSTAYMELSSLRSEDTAVYYCAAVDCNSTSCYDAFDIWGQGTMVTVSS | 90 | EIVLTQSPGTLSLSPGERATLSCRASQSFRSSYLAWYQQKPGQAPRLLIYGASSRATGIPDRFSGSGSGSDFTLTISRLEPEDFAVYYCQQYDISPWTFGQGTKVEIK |
| | C598 | 6.2 m | 91 | QVQLVQSGPEVKKPGTSVKVSCKASGFTFSSSAVQWVRQARGQRLEWIGWIVVGSGNTNYAQKFQERVTITRDMSTSTAYMELSSLRSEDTAVFYCAAPYCNVTTCFDGFNIWGRGTMVTVSS | 92 | EIVLTQSPGTLSLSPGERATLSCRASQSVRSSYFAWYQQKPGQAPRLLIYAASSRATGIPDRFSGSGSGTDFTLTISRLEPEDFALYYCQQYGSSPWTFGQGTKVEIK |
| COV96 | C523 | 6.2 m | 93 | QVQLQESGPGLVKPSETLSLTCTVSGASISSHYWSWIRQPPGKGLEWIGYIHYIGSTNYNPSLKSRVTILLDTSKNQFSLRLRSVTAADTAVYYCARGWPYCGVDCYSGFDYWGQGTLVTVSS | 94 | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGLWVFGGGTKLTVL |
| | C524 | 6.2 m | 95 | EVQLVESGGDLIQPGGSLRLSCAASGFSVSNSYMSWVRQAPGKGLEWVSIIYSGGSTYYADSVKGRFTISRDNSKNTLYLQMNSLRAEDTAVYFCAKTPRGDYDSSGTSAYWGQGTLVTVSS | 96 | QLVLTQSPSASASLGASVNLTCTLSSGHSSYAIAWHQQQPEKGPRFLMKLSSDGSHNKGDGIPDRFSGSSSGAERFLTISSLQSEDEADYYCQTWGIGSDWVFGGGTKLTVL |
| | C525 | 6.2 m | 97 | EVQLVESGGRLVQPGRSLRLSCAASGFTFDDYAIHWVRQAPGKGLEWVSGISWNSGSIGYADSVRGRFTISRDNAKNSLYLQMNSLRAEDTALYYCAKGLDSSSSASPDYWGQGTLVTVSS | 98 | DIQMTQSPSSVSASVGDRVTITCRASQDISSWLAWYQQKPGKAPKLLIYLASSLQSGVPSRFSGSGSGTDHLTISSLQPEDFGTYYCQQGNSFPLTFGGGTKVEIK |
| | C526 | 6.2 m | 99 | QVQLVQSGAEVKKPGASVKVSCKASGHTFTTYYLHWVRQAPGQGLEWMGRIDPSGGSTTYAQKFQGRVTMTRDTSTSTVYMELSSLRSEDTALYYCARGGYCGSTSCSPDDYFDYWGQGTLVTVSS | 100 | SYELTQPPSVSVAPGKTARITCGGNNIGSKSVHWYQQKPGQAPVLVIYYDSDRPSGIPERFSGSNSGNTATLTISRVEAGDEADYYCQVWDSSSDHYYVFGTGTKVTVL |
| | C527 | 6.2 m | 101 | QVQLVESGGGVVQPGRSLRLSCAASGFTFSSYGMHWVRQAPGKGLEWVALIGYDGTDKYYAENVKGRFTISRDNSKNTLFLQMNSLRGGDTAVYLCARDGIPFRYGMDVWGQGTTVTVSS | 102 | DIQMTQSPSTLSASVGDRVTITCRASQSIDIWLAWYQQKPGKAPKFLIHKASTLESGVPSRFSGSGSGTEFTLTISSLQPDDFATYYCQHYHSYSGTFGQGTKVEIK |
| | C528 | 6.2 m | 103 | EVQLVESGGGLVQPGGSLRLSCAASGFTFRNYDMHWVRQVAGKGLEWVSAIGTSGDTYYPDSVKGRFTISRENAKNSVYLQMNNLRAGDTAVYFCVRDREISGWTGWYFDLWGRGTLVTVSS | 104 | DIQMTQSPSSLSASVGDRVTITCRASQTIHNYLNWYQQIPGKAPRLLIYATNTLQSGVPSRFSGSGSGTDFTLTITGLQPEDFATYYCQQSYSTPPITFGQGTRLEIK |
| | C529 | 6.2 m | 105 | EVQLLESGGGLVQPGGSLRLSCAASGFTFNNYAMNWVRQAPGRGLEWVSGISGSGANTYYADSVKGRFTISRDNPKNTLSLQMNSLRAEDTALYYCAKVLSPTYYDSWSGPDAFDFWGQGTMVTVSS | 106 | DIQMTQSPSTLSASVGDRVTITCRASQTISPWLAWYQQKPGKAPNLLIYKASSLESGVPSRFSGSGSGTEFTLTISSLQPDDFATYYCQQYNSYSSWTFGQGTKVEIK |
| | C530 | 6.2 m | 107 | QVQLVESGGGVAQPGRSLRLSCAASGFTFSRYGMHWVRQAPGKGLEWVAVIWHDGSDKYCADFVKGRFTISRDNSKNTLYMQMDSLRAEDTAVYYCARGGRPDHETGIAVLGEYYFDSWGQGTLVTVSS | 108 | SYELTQPPSVSVSPGQTARITCSGDAFPLQYGYWYQQKPGQAPVLVIYKDKERPSGISERFSGSSSGTTVTLTISGVQAEDEADYYCQSADTNGVVFGGGTSLTVL |
| | C531 | 6.2 m | 109 | EVQLVESGGGLVQPGRSLRLSCVATGFTFDDFAMHWVRQAPGKGLEWVSGISWNGGIIGYVDSVKGRFTISRDNAKNSLYLQMNSLRPEDTALYYCVKGYRYYYDILTGYYNDAGAFDYWGQGTLVTVSS | 110 | DIQSTQSPSFLSASVGDRVAITCRASQGISSYLAWYQQKPGKAPKLLIYPASTLQSGVPSGFSGSGSGTEFTLTISSLQPEDFATYYCQQLNDYPFTFGPGTKVDIK |

TABLE 4A-continued

| Patient ID | Anti-body ID | Time point | SEQ ID NO | IGH VDJ (aa) | SEQ ID NO | IGL VJ (aa) |
|---|---|---|---|---|---|---|
| Sequences of cloned recombinant antibodies | | | | | | |
| | C532 | 6.2 m | 111 | EVQLVQSGAEVKKPGESLKISCKGSGYRFTNYWIGWVRQNIPGKGLEWIGNIFPGDSDSRYSPSFQGQVTISVDMSITTAYLHWSSLKASDTAIYYCARLSERWYSPFDSWGQGTLVTVSS | 112 | EIVMTQSPATLSVSPGERATLSCRASQSVSSNLAWYQQKPGQAPRLLIYGASTRATGFPARFSGSGSGTEFTLTISSLQSEDFAVYFCQQYNNWPPGGFTFGPGTKVDIK |
| | C533 | 6.2 m | 113 | EVQLVESGGSLVKPGGSLRLSCVASGLTFNHAWMSWVRQAPGKGLEWVGRIKSKIDGGTTDYAAPVKGRFTISRDDSKSTQYLQMNSLKTEDTAVYYCTTDCFWRLGGTTCYEHDAFDVWGQGTMVTVSS | 114 | DIQMTQSPSSLSASVGDRVTITCRASQAIATFLNWYQQKPGKAPKLLIYAASSLQSGVPSRFSGSGSGTDFTLTISNLQPEDFATYYCQQSYNSLHFGGGTKVEIK |
| | C534 | 6.2 m | 115 | QVQLVQSGAEVKKPGSSVRVSCKASGGTFSRNVISWVRQAPGQGLEWMGGIIPMFATANYAQKFQGRVTITADESSSTAYMELSSLRSEDTAVYYCAREDFILVSAPIRENSYYYYGMDVWGQGTTVTVSS | 116 | EIVLTQSPGTLSLSPGERATLSCRASQSVSSNYLAWYQQKPGQAPRLLIYDASSRATGIPDRFSGSGSGTDFTLTISRLEPEDFAVYYCQQYGGSPRTFGQGTKVEIK |
| | C535 | 6.2 m | 117 | EVQLVESGGALVQPGRSLRLSCAASGFTFDDYAMHWVRQAPGKGLEWVSSISWNGVSIGYADSVRGRFTISRDNAKNSLYLQMNSLKIGDTAFYYCARGLDGSSSASPDSWGQGTLVTVSS | 118 | DIQMTQSPSSVSASVGDRVTITCRASQGIGSWLAWYQQKPGKAPKLLIYLASSLQSGVPSRFSGSGSGTYFTLTISGLQPEDFATYYCQQGNSFPLTFGGGTKVEIK |
| | C536 | 6.2 m | 119 | QVQLVESGGGLVKPGRSLRLSCTVSGFTFGAYAMSWFRQAPGKGLEWVGFIRSKTYGGTTEYAASLKGRFTISRDDSKSIAFLQMNSLKTEDTAVYFCSRGGYYDGSPYYWNRPDAFDIWGLGTMVTVS | 120 | QSVLTQPPSASGTPGQRITISCSGSSSNIGSNTVNWYQQLPGTAPKLLIYSNNQRPSGVPDRFSGSKSGTSASLAISGVQSEDEADYYCAAWDDSLNGPDVVFGGGTKLTVL |
| | C537 | 6.2 m | 121 | QLQLQESGPGLVKPSETLSLTCTVSGGAISSRNYHWGWIRQPPGKGLEWIGSIYYSGSTYYSPSLKSRVTISVDTSKNQFSLRLSSVTAADTAVYYCARLETSGWYTEDVFDIWGQGTMVTVSS | 122 | DIQMTQSPSSLSASVGDRVTITCRASQSISSYLNWYQQKPGKAPKLLIYAASSLQSGVPSRFSGSGSGTDFTLTISSLLPEDFATYYCQRSYSAMYTFGQGTKLEIK |
| | C538 | 6.2 m | 123 | QLQLQESGPGLVKPSETLSLTCTVSGGSISSSSYYWAWIRQPPGKGLEWIGNIYYSGITYYSPSLKSRVTISVDTSKNQFSLKLRSVTAADTAVYYCARQHRYGSGSSELLWGQGTLVTVSS | 124 | QSALTQPPSASGSPGQSVTISCTGTSSDVGSYNYVSWYQQHPGKAPKLMIYEVTKRPSGVPDRFSGSKSGNTASLTVSGLQADDEADYYCSSYAGSSNLIFGGGTKLTVL |
| | C539 | 6.2 m | 125 | EVQLVESGGGLVQPGRSLRLSCAASGFTFDDYALHWVRQAPGKGLEWVSGISWNGDSIGYADSVKGRFTISRDNAKNSLSLQMNSLTAEDTALYYCAKGVEYSSSSNCDYWGQGTLVTVSS | 126 | DIQMTQSPSSVSASVGDRVTITCRASQDISSWLAWYQQKPGKAPKLLISLASGLQSGVPSRFSGSGSETDFTLTISSLQPEDFATYYCQQTNSFPLTFGGGTKVEI |
| | C540 | 6.2 m | 127 | EVQLVESGGGLVQPGGSLRLSCAASGFTFRNYDMHWVRQVAGKGLEWVSAIGTSGDTYYPDSVKGRFTISRENAKNSVYLQMNNLRAGDTAVYFCVRDREISGWTGWYFDLWGRGTLVTVSS | 128 | DIQMTQSPSSLSASVGDRVTITCRASQTIHNYLNWYQQIPGKAPRLLIYATNTLQSGVPSRFSGSGSGTDFTLTITGLQPEDFATYYCQQSYSTPPITFGQGTRLEIK |
| | C542 | 6.2 m | 129 | EVQLVESGGGLVQPGGSLRLSCAASGLTVTSNYMSWVRQAPGRGLEWVSLIYPGGTTYYADSVKGRFTVSRDNSKNTLYLQMDSLRAEDTGVYYCARETLGRGGDCWGQGTLVTVSS | 130 | DIQMTQSPSSLSASVGDRVTITCQASQDISNFLNWYQQKPGKAPKLLIYDASNLETGVPSRFSGSRSGTDFTFTISSLQPDDIATYYCQQYDNLPRSFGQGTKLEIK |
| | C543 | 6.2 m | 131 | QVQLVESGGGVVQPGRSLRLSCTASGFTFSTAGMHWVRQAPGKGLEWVAVISYDGSNKDYADSVKGRFTISRDNSKSTLYLQMNSLRPEDTAVYYCAKDTPGGDDWITGWGLYGMDVWGQGTTVTVSS | 132 | DIQMTQSPSSLSASVGDRVTITCRASQSISSYLNWYHQKPGKAPKLLIYAAISLQSGVPSRFSGSGFGTDFTLTISSLQPEDFAIYYCQQSYSTPWTFGQGTKVEIK |

TABLE 4A-continued

| Sequences of cloned recombinant antibodies | | | | | | |
|---|---|---|---|---|---|---|
| Patient ID | Anti-body ID | Time point | SEQ ID NO | IGH VDJ (aa) | SEQ ID NO | IGL VJ (aa) |
| | C544 | 6.2 m | 133 | QVQLVQSGAEVKKPGASVKVSCKASGYTFSSHDINWVRQATGQGLEWVGWMNPNSGNTGSAQSFQGRVTLTRNASISTAYLELSSLRSEDTAVYFCARGFSLTWYFDLWGRGTLVTVSS | 134 | SYELTQPPSVSAAPGKTARITCGGNNIGGKNVHWYQQKPGQAPVLVVFDDSDRPSGIPERFSGSNSGNTATLTISRVEAGDEADYYCQLWDSTSDHPDVVFGGGTQLTVL |
| | C545 | 6.2 m | 135 | EVQLLESGGGLVKPGGSLRLSCAASGFTFSDYSMTWVRQAPGKGLEWVSFISSSSTYIYYADSVKGRFTISRDNAKSSLYLQMNRLRAEDTAVYYCTRVQVGARGWADYWGQGTLVTVSS | 136 | NFMLTQPLSVSESPGKTVTISCTRSSGSIASNYVQWYQQRPGGAPTTVIYEDTQRPSGVPDRFSGSIDSSSNSASLTISGLKTEDEADYYCQSCDTINWVFGGGTKLTVV |
| | C546 | 6.2 m | 137 | EVQLLESGGGLVHPGGSLRLSCAASGFTFSTYAMHWVRQAPGKGLEWVSAISGSGTGTFYADSVKGRFSISRDNSKNTLYLQMNSLRAEDTAVYYCATERIAVSDTRMYNWFDPWGQGTLVTVSS | 138 | DIQMTQSPSSLSASVGDRVTLTCRASQGISTYLNWYQQKPGKAPNLLIYAASSLQSGVPSRFSGSGSGTDFTLTISSLQPEDFATYYCQQSYSAPPWTFGQGTKVEIK |
| | C547 | 1.3 m | 139 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDTPGGDDILTGWGLYGMDVWGQGTTVTVSS | 140 | DIQMTQSPSSLSASVGDRVTITCRASQSISSYLNWYQQKPGKAPKLLIYAAFSLQSGVPSRFSGSGSGTDFTLTISSLQPEDFATYYCQQSYSTPWTFGQGTKVEIK |
| | C548 | 1.3 m | 141 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARREAYGPRDYYYYYGMDVWGQGTTVTVSS | 142 | QSALTQPPSASASLGASVTLTCTLSSGYSNYKVDWYQQRPGKGPRFVMRVGTGGIVGSKGDGIPDRFSVLGSGLNRYLTIKNIQEEDESDYHCGADQGSGSNFVGVFGGGTKLTVL |
| | C549 | 6.2 m | 143 | QVQLVQSGAEVKKPGSSVKVSCKASGGTFSTSAISWVRQAPGQGLEWMGGIIPFFGTPNYAQKFQGRVTIIADESTTTAYMELSGLRFEDSAVYYCARREPYGPRDYYYFFGMDVWGPGTTVTVSS | 144 | QSALTQPPFASASLGASVTLTCTLSSDYSYYKVDWYQQRPGKGPRFVIRVGPGGIVGSKGDGFPDRFSVLGSGLNRSLTINNIQEEDEGDYHCGADEGSGGTFVGVFGGGTKLTV |
| | C550 | 1.3 m | 145 | EVQLVQSGAEVKKPGESLKISCKGSGYRFTNYWIGWVRQMPGKGLEWMGIIYPGDSDTRYSPSFQGQVTISADKSITTAYLQWSSLKASDTAMYYCARLSDRWYSPFDPWGQGTLVTVSS | 146 | EIVMTQSPATLSVSPGERATLSCRASQSVSSNLAWYQQKPGQAPRLLIYGASTRATGIPARFSGSGSGTEFTLTISSLQSEDFAVYYCQQYNNWPPGGFTFGPGTKVDIK |
| | C552 | 1.3 m | 147 | QVQLVESGGGVVQPGRSLRLSCAASGFTFSSYAMHWVRQAPGKGLEWVALISYDGSNKHYADSVKGRFTISRDNSKNTLYLQMNSLRAEDTAVYYCARAGTTNSDYFDYWGQGTLVTVSS | 148 | SYELTQPPSVSVAPGKTARITCGGNNIGSKSVHWYQQKPGQAPVLVIYYDTDRPSGIPERFSGSNSGNTATLTISRVEAGDEADYYCQVWDSSSALWVFGGGTKLTVL |
| | C553 | 6.2 m | 149 | QVQLVESGGGVVQPGRSLRLSCAASGFTFSNYEIHWVRQAPGKGLEWVAGISYDGSTKYYADSVKGRFTISRDNSKNTLYLQMNSLRPEDTAVFYCARAGTTNSDYFDYWGQGTLVTVSS | 150 | SYELTQPPSVSVAPGMTARITCGGNTIGSKSVHWYQQKAGQAPVLVIYYDSDRPSGIPERFSGSNSGNTATLTISRVEAGDEADYYCQVWDSSSVLWVFGGGTKLTVL |
| | C554 | 1.3 m | 151 | EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDDPGSYYYGMDVWGQGTTVTVSS | 152 | QTVVTQEPSLTVSPGGTVTLTCGSSTGAVTSGHYPYWFQQKPGQAPRTLIYDTSNKHSWTPARFSGSLLGGKAALTLSGAQPEDEAEYYCLLSYSGARVFGGGTKLTVL |
| | C555 | 6.2 m | 153 | EVQLVESGGGLVKPGGSLRLSCAASGLTFSTTWMSWVRQAPGKGLEWVGRIKSKGDGGTTDFAGPVKGRFSISRDDSKNTLYLHMNSLKTEDTAVYYCTTDDPGSYYYGMDVWGQGTTVTVSS | 154 | QTVVTQEPSLTVSPGGTVTLTCASSTGAVTSGHYPYWFQQKPGQAPRTLIYATSNKHSWTPARFSGSLLGGKAALTLSGAQPEDEADYYCLLSYSGARVFGGGTKLTVL |

TABLE 4A-continued

| Sequences of cloned recombinant antibodies | | | | | | |
|---|---|---|---|---|---|---|
| Patient ID | Anti-body ID | Time point | SEQ ID NO | IGH VDJ (aa) | SEQ ID NO | IGL VJ (aa) |
| | C556 | 1.3 m | 155 | QVQLVQSGAEVKKPGASVKVSCKASGYTFTYYYMHWVRQAPGQGLEWMGIINPSGGSTSYAQKFQGRVTMTRDTSTSTVYMELSSLRSEDTAVYYCARPLLPGETGSLNRLDYWGQGTLVTVSS | 156 | DIQMTQSPSSLSASVGDRVTITCRASQSISSYLNWYQQKPGKAPKLLIYAASSLQSGVPSRFSGSGSGTDFTLTISSLQPEDFATYYCQQSYSTLWTFGQGTKVEIK |
| | C557 | 6.2 m | 157 | QVQLVQSGAEVKKPGASVKVSCKASGYPFSRYYIHWVRQAPGQGLEWMGIINPSGGSTTYAQRFQGRVTMTRDTSASTVYLDLSSLGSEDSAVYYCARPLLPGETGNLNRLDYWGQGTLVTVSS | 158 | DIQMTQSPSSLSASVGDRVTITCRASQSISSYLNWYQQKPGIAPXLLIYGASSLQSGVPSRFSGSGSGTDFTLTISSVQPDDFATYYCQQSYSTLWTFGQGTKVEIK |
| | C558 | 1.3 m | 159 | EVQLVQSGAEVKKPGESLKISCKVSGYTFTNYWIGWVRQMPGKGLEWMGIIYPGDSDTRYSPSFQGQVTISADKSIITAYLQWSSLKASDTAMYYCARVPSSSDYGDYGGFEYWGQGTLVTVSS | 160 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPCSFGQGTKLEIK |
| | C559 | 6.2 m | 161 | EVQLVQSGAEVKKPGESLKISCKVSGYTFTNYWIGWVRQMPGKGLEWMGIIFPGDSDTRYSPSFQGQVTISADRSITTAYLQWRSLKASDTAMYYCARVPSSSDYGDYGGFEYWGQGTLVTVSS | 162 | DIQMTQSPSSLSASVGDRVTITCRASQTITIYLNWYQQKPGKAPKLLIYAASSLQSGVPSRFSGSGSGTDFTLTISSLQPEDFATYYCQQSYSTPCSFGQGTKLEIK |
| | C560 | 1.3 m | 163 | EVQLVESGGGLVQPGRSLRLSCAASGFTFDDYA1VII1WVRQAPGKGLEWVSGVSWNSGTIGYADSVKGRFTISRDNAKNSLYLQMNSLRAEDTALYYCAKIADIVRAYDFWSGQHFDAFDIWGQGTMVTVSS | 164 | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLVVFGGGTKLTVL |
| | C56 | 6.2 m | 165 | EVQLVESGGGLVQPGRSLRLSCAASGFTFDDYAIHWVRQAPGKGLEWVSGVSWNSGTIGYADSVKGRFFISRDNAKNSLYLQMNSLRAEDTAWYYCAKIADLVGAYDFRSGQHFAAFDVWGQGTMVTVSS | 166 | QSVLTQPPSASGTPGQRVTISCSGSSSNIGSNTVNWYQHLPGTAPKLLIYSNNQRPSGVPDRFSGSKSGTSASLAISGLQSEDEADYYCASWDDSLVVFGGGTKLTVL |
| | C562 | 6.2 m | 167 | EVQLVESGGGVVQPGKSLRLSCAASGFTFRSYAMHWVRQAPGKGLEWVAVIWDDGSSKHYSDSVKGEIFTISRDNSKNTLYLQMNSLRAEDTAVYYCARDSNVDTVMVTWFDYWGQGTMVTVSS | 168 | DIQMTQSPSSLSASVGDRVTITCRASQSISNYLNWYQQKPGKAPNLLIYTASSLQSGVPSRFSGSGSGTDFTLTISSLQPEDFATYYCQQSYSTPPWTFGQGTKVEIK |
| | C563 | 6.2 m | 169 | EVQLVESGGGLVKPGGSLRLSCAASGFPFTNAWMSWVRQAPGKGLEWVGHIKDYTDGGTTDYAAPVKGKFTISRDDSKNTLYLHMNSLKTEDTAVYYCSTVGSYYYDSRGPTSDAFDIWGQGTLVTVSS | 170 | DIVMTQSPDSLAVSLGERATINCKSSQSVLYSSNKKNYLAWYRQKPGQPPKLLIYWASTRESGVPDRFSGSGSGTDFTLTISSLQAEDVAVYYCQQYYSTPYTFGQGTKLEIK |
| | C564 | 1.3 m | 171 | EVQLLESGGGLVQPGTSLRLSCAASGFTFSSYAMSWVRQAPGKGLEWVSAISSSGGSTYYADSVKGRFTISRDNSKNTLYLHMNSLRAEDTAVYYCATERIAVAGTRMYNWFDPWGQGTLVTVSS | 172 | DIQMTQSPSSLSASVGDRVTLTCRASQSISSYLNWYQQKPGKAPNLLIYAASSLQSGVPSRFSGSGSGTDFTLTISSLQPEDFATYYCQQSYSAPPWTFGQGTKVEIK |
| | C213 | 1.3 m | 173 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVQVGARGWVDYWGQGTLVTVSS | 174 | NFMLTQPHSVSESPGKTVTISCTRSSGSIASNYVQWYQQRPGSAPTTVIYEDNERPSGVPDRFSGSIDSSSNSASLTISGLKTEDEADYYCQSYDRINWVFGGGTKLTVL |
| | C217 | 1.3 m | 175 | EVQLVESGGGLVKPGGSLRLSCAASGFTFSSYSMNWVRQAPGKGLEWVSFISSRSSYIYYADSVKGRFTISRDNAKNSLYLQMNSLRAEDTAVYYCARVQVGARGWVDYWGQGTLVTVSS | 176 | NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSINWVFGGGTKLTVL |

TABLE 4A-continued

Sequences of cloned recombinant antibodies

| Patient ID | Antibody ID | Time point | SEQ ID NO | IGH VDJ (aa) | SEQ ID NO | IGL VJ (aa) |
|---|---|---|---|---|---|---|
| COV57 | C070 | 6.2 m | 177 | VQLVESGGGVVQPGGSLRLSCVASGFEFRDYGMHWVRQAPGKGLHWVAIVQSDGKNIYYADSVKGRFTISRDNSKRSQYLQMNSLRPEDTAVYYCAKENYRGTGYLESWGQGTLVTVSS | 178 | DIQMTQSPSTLAASVGDTVTITCRASYDVKKWVAWYQQKPGKVPKLLIYKASTLEVGVPLRFSGSGSGTEFTLTINGLQPDDFATYYCQHFHSYPYSFGQGTKLEIK |
| | C073 | 6.2 m | 179 | QLQLQESGPGLVKPSETLSLTCTVSGASIPSSTSYWGWIRQPPGKGLEWIGSIYYTGSTYYNPSLKSRVTISVDTSKNHFSLILSSVTAADTAVYYCARRSITLAGRDCLDFWGQGTLVTVSS | 180 | DIQLTQSPSSLSASVGDRLTITCRASQSITTSLNWYQQKPGKAPKLLIYAASSLQSGVPSRFSGSGSGTDFTLAISSLQPEDFATYYCQQSYIPLLTFGGGTKVDIK |
| | C075 | 6.2 m | 181 | VQLLESGPGLLKPSQTLSLTCAISGDSVSSSGAAWNWIRQSPSRGLEWLGRTYYKSKWYNDYAVSVKSRITINPDTSKNQFSLQLNSVTPEDTAVYYCARMWVVAGTTDDYYYHYGMDVWGQGTTVTVSS | 182 | IRMTQSPSSVSASVGDRVTITCRASQGISNWLAWYQQKPGKAPKVLLYAASSLRSGVPSRFSGSGSGTDFTLTISSLQPEDFATYYCQQTNTLPLSFGGGTKVD1K |
| | C077 | 6.2 m | 183 | QVQLVQSGAEVKKPGASVKVSCKASGYTFTSYAMHWVRQAPGQRLEWMGWINTDNGNTKYSQKFQGRVTITRDTSASTAYMELSSLRSEDTAVYYCAREGALTNWFDPWGQGTLVTVSS | 184 | SYELTQPPSVSVAPGQTARIPCGGNNIGSKSVHWYQQKPGQAPVLVVYDDSDRPSGIPERFSGSNSGNTATLTISRVEAGDEADYYCQVWDSSSDLHVVFGGGTKLTVL |
| | C078 | 6.2 m | 185 | QVQLQQWGAGLLKPSETLSLTCAVYGGSLSAYYWSWIRQPPGKGLEWIGEINNGGTTNYNPSLKSRVTLSVDTSKNQFSLELSSVTAADTAIYYCARPGITATTGFDFWGQGSLVTVSS | 186 | SYELTQPPSVSVAPGQTARIPCGGNNIGSKSVHWYQQKPGQAPVLVVYDDSDRPSGIPERFSGSNSGNTATLTISRVEAGDEADYYCQVWDSSSDLHVVFGGGTKLTVL |
| | C079 | 6.2 m | 187 | VQLVESGGGVVQPGGSLRLSCAASLFSFSDYGMHWVRQAPGKGLEWVAFIWYDGTKKDYTHSVKGRFTVSRDNSKNTLYLQMNSLRAEDTAMYYCAKARGFQHYFDQWGQGTLVTVSS | 188 | QSALTQPASVSGSPGQSITISCTGTSSDVGSYNLVSWYQQHPGKAPKLLIYEVGKRPSGVSNRFSGSKSGNTASLTISGLQAEDEADYYCCSYAGSGTLGVVFGGGTKLTVL |
| | C080 | 6.2 m | 189 | EVQLVQSGAEVKKPGESLNISCKASGYSFTIYWIAWVRQLPGKGLEWMGIIYPGDSDTRYSPSFQGQVTISADKSISTAYLQWRSLKASDSAVYYCARGVAVDWYFDLWGRGTLVTVSS | 190 | QSVLTQPPSVSGAPGQRVTISCAGSSSNIGAGFDVYWYQQLPGTAPKLLIYGNNNRPSGVPDRFSGSKSGTSASLAITGLQAEDEADYYCQSSGSVLSDLYVFGTGTKVTVL |
| | C091 | 1.3 m | 191 | QVQLVQSGAEVKKPGSSVKVSCKASGGTFSSYTISWVRQAPGQGLEWMGRIIPILGIANYAQKFQGRVTITADKSTSTAYMELSSLRSEDTAVYYCARDSGYSGYGSTYYMDVWGKGTTVTVSS | 192 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTVTKVTVL |
| | C092 | 6.2 m | 193 | QVQLVQSGAEVKKPGSSVKVSCKASGGSFTNHFISWVRQAPGQGLEWMGRIIPILGTANYAQNFQGRVMMTADKSTSTAYMELSSLRSEDTAVYYCARDSGYSGYGSTYYMDVWGKGTTVTVSS | 194 | QSVLTQPPSVSGAPGQRVTISCTGSNSNIGAGYDVHWYQQLPGAAPKLLIYGNNNRPSGVPDRFSGSKSDTSASLAITGLQVEDEADYYCQSYDSSLSDSVFGSGTKVTVL |
| | C093 | 1.3 m | 195 | QVQLQESGPGLVKPSETLSLTCTVSGGSISSYYWSWIRQPPGKGLEWIGYIHYSGSTNYNPSLKSRVTISVDTSKNQFSLKLSSVTAADTAVYYCARHYDILTALSWFDPWGQGTLVTVSS | 196 | QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYWVFGGGTKLTVL |
| | C094 | 6.2 m | 197 | QVQLQESGPGLVKPSETLSLTCNVSGVSISTDYWSWIRQPPGKGLEWIGYIYYSGNTKDYNPSLKSRVTISVDTSKNQFSLMLSSVTAADTAVYYCARHYDILTSLSWFDPWGQGTLVTVSS | 198 | QSVLTQPPSVSAAPGQKVTISCSITNSNLGNIYVSWYQQLPGTAPKLLIYGNNKRPSGIPDRFSGSKSGTSATLGITGLQTGDEAHYYCGTWDSSLSANWVFGGGTKLTVL |

TABLE 4A-continued

Sequences of cloned recombinant antibodies

| Patient ID | Antibody ID | Time point | SEQ ID NO | IGH VDJ (aa) | SEQ ID NO | IGL VJ (aa) |
|---|---|---|---|---|---|---|
| | C034 | 1.3 m | 199 | QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARDSEYSSSWYSRGYYGMDVWGQGTTVTVSS | 200 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPTFGGGTKVEIK |
| | C035 | 1.3 m | 201 | EVQLVESGGGLVQPGGSLRLSCAASGFIFSSYWMTWVRQAPGKGLEWVASIKYNGNERNYVDSVKGRFTISRDNARNSLFLQLNNLGAEDTAVYYCARQPESTIWYYFDYWGQGTLVTVSS | 202 | SYELTQPPSVSVSPGQTARVTCSGHALPDQYTYWYQQRPGRAPVLVIYVNNQRPSGIPDRFSATTSGTTVTLTISGVQAEDEADYYCQSADSSGSYVVFGGGTKLTVL |
| | C520 | 6.2 m | 203 | QVQLQQWGAGLLKPSETLSLTCAVFGGSFSGYYWGWIRQPPGKGLEWIAEINHSENSHYNPSLKSRVTISVDTFKNQFSLNLSSVTAADTALYYCVRRPRRYCSGDTCRGAFDIWGQGTMVTVSS | 204 | DIQMTQSPSSLSASVGDRVTITCRASQDISNFLAWYQQKPGKVPSLLIYAASILQPGVPSRFSGSGSGTDFTLTITSLQPEDVATYYCQKYKIDPFTFGPGTKVDIK |
| | C521 | 6.2 m | 205 | EVQLVESGGGLVRPGGSLTLSCVASGFTVGSNFMSWVRQAPGKGLEWVSLIYNSGGTHYADSVKGRFTISRDRSKNTLYLQMNSLRAEDTAIYYCANHGYYYYMDVWGKGTTVTVS | 206 | QSALTQPASVSGSPGQSITISCTGTGSDIGAYNYVSWHQHHPGKAPKLIIYDVSNRPSGVSNRFSGSKSGNTASLTISGLQAEDEADYYCTSYTNTTTPWVFGGGTKVTVL |
| | C522 | 6.2 m | 207 | EVQLVESGGGLIQPGGSLRLSCAASEFIVSRNYMSWVRQAPGKGLEWVSVIYSGGSTFYADSVKGRFTISRDESKNTLYLQMNSLRAEDTAIYYCARDRGGGILDYWGQGTLVTVS | 208 | DIQMTQSPSSLSASVGDRVTITCQASQDINIFLNWYQQKPGKAPKLLIYDASSLETGVPSRFSGSGSGTDFTFTISSLQPEDFATYYCQQYGNLPKYTFGQGTKLEIK |
| COV21 | C095 | 6.2 m | 209 | VQLVEAGGGVVQPGRSLRLSCAASGLAFSIYGMHWVRQAPGKGLEWVAIVAQDGSKKYYADSVKGRFTISRDNSKNTLYLEMNSLRTEDTAVYYCVKEGRPSDTVVVVAFDYWGQGSLVTVSS | 210 | DIQLTQSPSSLSASVGDRVTITCRASQSISNYLNWYQQKPGKAPKVIIYAASSLQSGVPSRFSGSGSGTDFTLTISSLQPEDFATYYCQQSHSIPRTFGQGTKVEIK |
| | C096 | 6.2 m | 211 | EVQLVESGGGLVKPGGSLRLSCVASGFTFRNAWMNWVRQAPGKGLEWVGRIKANSDGGTIDYAEPVQGRFTISREDSRNSLYLQMNSLKTEDTAVYYCTTGPQYDDFGHSYIVDSWGPGTLVTVSS | 212 | DIVMTQSPLSLPVTLGEPASISCRSSQSLLHSNGFHFLEWYLQKPGQSPQLLIYVGSNRASGVPDRFSGSGSGTDFTLKISRVEAEDVGVYYCMQTLQTPLTFGGGTKVEIK |
| | C097 | 6.2 m | 213 | QVQLQESGPGLVKPSQTLSLTCTVSGGSISSGPYYWSWIRQHPGKGLEWIGYIYYSGSTYYNPSLKSRVTISVDTSKKQFSLNLNSVTAADTAVYYCARVWQYYDSTGSFDYWGQGTLVTVSS | 214 | DIVMTQSPLSLPVTPGEPASISCRSSRGLLHSNGYNYLDWYLQKPGQSPQLLIYLGSNRASGVPDRFSGSGSVTDFTLNISRVEAEDVGVYYCMQALQTPFTFGPGTKVDIK |
| | C098 | 1.3 m | 215 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDLYSSGGTDIWGQGTMVTVSS | 216 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPGTFGQGTKVEIK |
| | C099 | 6.2 m | 217 | EVQLVESGGGLIQPGGSLRLSCAASGITVSSNYMSWVRQAPGKGLEWVSVMYAGGSTFYADSVKGRFTISRDDSKNTLFLQMNSLRAEDTAIYYCARDLYSSGGTDIWGQGTMVTVSS | 218 | EIVLTQSPGTLSLSPGERATLSCRASQSIGSSYLAWYQQKPGLAPRLLIYGASRRATGIPDKFSGSGSGADFTLTISRLEPEDFAVYYCQQYGSSPGTFGQGTKVEIK |
| | C043 | 6.2 m | 219 | QLVQSGPEVKKPGTSVKVSCKASGFTFYNSAVQWVRQARGQRLEWVGWIVVGSGNTDYAQKFQERVTMTRDLSTNTAYMEVNSLRSEDTAVYYCAAPYCSGGTCLDGFDIWGQGTMVTVSS | 220 | EIVLTQSPGTLSLSPGERGTLSCRASQSVRSNYLAWYKQRPGQAPRLLVYGASSRATGIPDRFSGSGSGTDFTLTISRLEPEDFAVYYCQQYGSSPWTFGQGTKVEIK |

TABLE 4A-continued

Sequences of cloned recombinant antibodies

| Patient ID | Antibody ID | Time point | SEQ ID NO | IGH VDJ (aa) | SEQ ID NO | IGL VJ (aa) |
|---|---|---|---|---|---|---|
| | C044 | 1.3 m | 221 | EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAREAHDGALTDYGDYLNWFDPWGQGTLVTVSS | 222 | SYELTQPPSVSVAPGKTARITCGGNNIGSKSVHWYQQKPGQAPVLVIYYDSDRPSGIPERFSGSNSGNTATLTISRVEAGDEADYYCQVWDSSSDHLYWVFGGGTKLTVL |
| | C045 | 6.2 m | 223 | EVQLVESGGGLVQPGGSLRLSCAASGFTFSTYSMNWVRQAPGKGLEWVSYISSSSSTIHYADSVKGRFTISRDNAKNSLYLQMNSLRDEDTAVYYCAREAHDGALTDYGDYLNWFDPWGQGTLVTVSS | 224 | SYELTQPPSVSVAPGKTARITCGGTNIGSKNVHWYQQKPGQAPVLVIYYDNDRPSGIPERFSGSNSGNTATLTISRVEAGDEADYYCQVWDTTSDHFYWVFGGGTKLTVL |
| | C046 | 6.2 m | 225 | EVQLVESGGGLAQPGRSLRLSCAASGFTFDDYAMHWVRQAPGKGLEWVSGINWNSGSLGYADSVKGRFTISRGIAKNSLYLQMNSLRPEDTAFYYCAKAGVRGIAAAGPDLNFDYWGQGTLVTVSS | 226 | EIVLTQSPATLSLSPGERATLSCRASQSVSSYLAWYQQKPGQAPRLLIYDASNRATGIPARFIGSGSGTDFTLTISSLEPEDFAVYYCQQRITFGQGTRLEIK |
| | C047 | 6.2 m | 227 | QVQLQESGPGLVKPSETLSLTCTVSGGSISSTTYYWDWIRQSPGKGLEWIGSIFYTGITYYSPSLKSRVTISVDTSKNQFSLRLNSMTAADTAVYYCARRLRQLWFGPWFDPWGQGTLVTVSS | 228 | YNYVSWYQQHPDKAPKLIIYEVTKRPSGVPDRFSGSKSGNTASLTVSGLQAEDEADYYCSSYAGSNNVMFGGGTKLTVL |
| | C048 | 1.3 m | 229 | VQLQESGPGLVKPSETLSLTCAVSGGSVSSGNYYWNWIRQPPGKGLEWIGYIYYSGSTNYNPSLKSRVTISVDTSKNQFSLKLNSVTAADTAVYHCARETYYYDSSGYYISDAFDIWGQGTMVTVSS | 230 | DIQMTQSPSTLSASVGDRVTITCRASQSISSWLAWYQQKPGKAPKLLIYKASSLESGVPSRFSGSGSGTEFTLTISSLQPDDFATYYCQQYNSFSYTFGQGTKLEIK |
| | C049 | 6.2 m | 231 | QVQLQESGPGLVKPSETLSLTCTVSGGSVSSGTFYWSWIRQPPGKGLEWIGYIHYSGSTNYNPSLKSRVTISVDTSKNQFSLRLSSVTAADTAVYYCARESFYYDRSGYYGSDAFDIWGQGTMVTVSS | 232 | DIQMTQSPSTLSSSVGDRVTITCRASQNISRWLAWYQQKPGKAPKLLIYKASTLESGVPSRFSGSGSGTKFTLTISSLQPDDFATYYCQQYNSYLYTFGQGTKLEIK |
| | C710 | 6.2 m | 233 | QVQLQESGPGLVKPSETLSLTCIVSGGSINSTTYYWDWIRQSPGKGLEWIGSIFYTGITYYSPSLKTRVTISVDTSKNQFSLRLNSMTAADTAVYYCARRLRQLWFGPWFDPWGQGTLVTVSS | 234 | QSALTQPPSASGSPGQSVTISCTGTRSDVGDYNYVSWYQQHPDKAPKLIIFEVTKRPSGVPDRFSGSKSGNTASLTVSGLQAEDEADYYCSSYAGSSNVMFGGGTKLTVL |
| | C703 | 6.2 m | 235 | EVQLLESGGGLVQPGGSLRLSCAGSGFTFSHYALSWVRQAPGKGLEWVSCISGTGGNSHYADSVKGRFTSSRDNSKNILYLQMNSLRAEDTAVYFCAKGGDFWSGYLIPFDSWGQGTLVTVSS | 236 | SYELTQSPSVSVAPGKTARITCGGDSIGSKNVHWYQQKPGQAPVLVMYYDNDRPSGIPERFSGYNSGNTATLSISRVEAGDEADYYCLVWDGSGDPWVFGGGTKLTVL |
| | C704 | 6.2 m | 237 | VQLVESGGGVVQPGRSLRLSCAASGFTFSRYGMHWVRQAPGKGLEWVAVSSYDGSNEYYANSVKGRFTISRDNSKNTLYLQMNSLRAEDTAVYYCAKTGASYCGGDCPFHFDYWGQGTLVTVSS | 238 | IRMTQSPSSLSASVGDRVTITCQASQDINNYLNWYQQKPGKAPKLLIYDASDLETGVPSRFSGGGSGTDFTFTISSLQPEDIATYYCQHYNNLPITFGQGTRLEIK |
| | C706 | 6.2 m | 239 | EVQLVESGGGLVKPGGSLRLSCAASGFTFSNVWMSWVRQAPGKGLEWVGRIKSKIDGGTTEYAAPVKGRFIISRDDSKNTLSLQMNSLKTEDTAVYYCTTDHGREPPVHWGQGTLVTVSS | 240 | EIVLTQSPGTLSLSPGERASLSCRARQSVYSNYLAWYQHKSGQAPRLLFYGASSRATDIPDRFSASGSGTDFTLTISRLEPEDFAVYYCLQYGPSPTFGPGTRLEIK |
| | C707 | 6.2 m | 241 | EVQLVESGGGLVKPGGSLRLSCAASGFTFSSYSMNWVRQAPGKGLAWVSSISSSNNIIYYADSVKGRFTISRDDAKDSLYLHMKSLRADDTAVYFCARVPSWAPYQLLPGPFDYWGQGILVTVSS | 242 | IRMTQSPSSLSASVGDRVTITCQASQAIASYLSWYQHKPGRAPKLLIYDASNLEIGVPSRFSGSGSGTDFTFTISSLQSEDNATYYCQQYESLPGTFGGGTKVEIK |

TABLE 4A-continued

| Sequences of cloned recombinant antibodies | | | | | | |
|---|---|---|---|---|---|---|
| Patient ID | Anti-body ID | Time point | SEQ ID NO | IGH VDJ (aa) | SEQ ID NO | IGL VJ (aa) |
| | C708 | 6.2 m | 243 | EVQLVESGGGLVQPGGSLRLSCAASGFSFSTYWMSWVRQAPGKGLEWVADIKQDGSEKYFVDSVKGRFTISRDNAKNSLYLHLNSLRAEDTAVYYCAREMAGSGNYYWFGYGMDVWGQGTTVTVSS | 244 | IRMTQSPSSVSASVGDRVTITCRASQGISSWLAWYQQKPGKAPKLLIYAASSLQSGVPSRFSGSESGTDFTLTISSLQPEDFATYYCQQANSFPLTFGGGTKVEIK |
| | C709 | 6.2 m | 245 | QVQLVQSGAEVRKPGASVKVSCMASGYTFNTYDINWVRQGTGQGLEWMGWMNPNSGNTGHAQKFQGRVAMTVNTSMNTAYMELSSLRSEDTAVYYCARGADMLNVAVGADFDYWGQGTLVTVSS | 246 | QSALTQPPSASGSPGQSVTISCTGTSSDVGGYNFVSWFQQHPGKAPKLMIYEVSKRPSGVPDRFSGSKSANTASLTVSGLQAEDEADYFC |
| COV107 | C565 | 6.2 m | 247 | EVQLVESGGGLIQPGGSLRLSCAASGLIVSSNYMNWVRQAPGKGLEWVSLLYSGGSTYYADSVKGRFTISRDNSKNTLYLQMNSLRPEDTAVYYCARDLSVVGAFDIWGQGTMVTVSS | 248 | SSYAGSNNWVFGGGTKLTVLYLAWYQQKRGQAPRLLIYGASSRATGIPDRFSGSGSGTDFTLTISRLEPEDFAVYYCQQYGTSPRVTFGPGTKVDIK |
| | C566 | 6.2 m | 249 | QVQLQESGPGLVKSSQTLSLNCSVFGASISSGGYYWTWIRQHPGKGLEWIGYIHYRGTYYNPSLKSRVTMSVDTSKNQFSLKVRSVSAADTAIYYCARAIVVVTLNWFDLWGQGTLVTVSS | 250 | NFMLTQPHSVSESPGKTVTISCSGSGGSIASNYVQWYQQRPGSAPTAVIYEDNQRPSGVPDRFSGSIDSSSNSASLTISGLKTEDEADYYCQSYDTSNPVIFGGGTKLTV |
| | C567 | 6.2 m | 251 | QVQLQESGPGLVKPSETLSLTCTVSGGSVINGSYYWSWIRQPPGKGLEWIGFVYYSGSTNYNPSLKSRVTISVDTSKNQFSLNLNSVTAADTAVYYCATGSKSSYYFDYWGQGTLVTVSS | 252 | QSVLTQPPSVSAAPGQKVTISCSGSSSNIGNNYVSWYQQLPGAAPKLLIYENNMRPSGIPDRFSGSKSGTSATLGITGLQTGDEADYYCGTWDSSLSVPYVFGTGTRVTVL |
| | C568 | 6.2 m | 253 | QVQLVQSGAEVKKPGASVKVSCTASGYTFSSYYTHWVRQAPGQGLEWMGIINPGAGSTSYAQKFQGRVAMTTDTSTRTVYMELSSLRSDDTAVYYCARDEAFLPSAIFVGDYWGQGTLVTVSS | 254 | DIQMTQSPSSLSASVGDRVTITCRASQGIRNDLGWYQQKPGKAPKRLIYAASNLQSGVPSRFSGSGSGTEFTLTISSLQPEDFATYYCLQHSTYPHTWTFGQGTKVEIK |
| | C569 | 6.2 m | 255 | QVQLVESGGNVVQPGRSLRLSCAASGFTFSNYGMHWIRQAPGKGLEWVAVISYDGSDKYYADSVKGRVTISRDNSKNTLYLQMNSLRAEDTAVYYCAKGGPYGDHVRSDYWGLGTLVTVSS | 256 | DIQMTQSPSSLSASVGDRVTITCQASQDISNYLNWYQQKPGKVPKLLIYDASNLETGVPSRFSGSGSGTDFTFTISSLQPEDIATYYCQQFHNLPLTFGQGTKLEIK |
| | C570 | 6.2 m | 257 | QVQLQESGPGLVKPSETLSLTCTVSGASISSYYWSWIRQPPGKGLEWIGYIYYSGSTNYNPSLKSRVTISLDTSKNQFSLQLSSVTAADTAVYYCATYYFDNSGYSYGLDVWGQGTTVTVSS | 258 | DIQMTQSPSSLSASVGDRVTIACRASQSISSYLHWYQQQPGKAPKLLIYAVTNLQSGVPSRFSGSGSGTDFTLTISSLQPEDFATYYCQQSYSLPQTFGQGTKVEIK |
| | C571 | 6.2 m | 259 | EVQLVESGGGLIQPGGSLKLSCVVSGFTVSRNYISWVRQAPGKGLEWVSVLFAGGSTFYADSVKGRFAISRDNSNNTLFLQMNSLRVEDTAIYYCARGDGELIFDQWGQGTLVTVSS | 260 | QSVLTQPPSVSGAPGQRVTIVCTGTSSNIGAGYDVHWYQQLPGRAPKVLVSGNN1RPSEVPDRFSGSRSGTSASLAITSLQPEDEAQYYCQSYDSNLYAVFGGGTKLTVL |
| | C572 | 6.2 m | 261 | EVQLVESGGGLIKPGRSLRLSCTASGFTFGDYAMTWFRQAPGKGLEWVGFIRSKAYGGTTGYAASVKYRFTISRDDSKSIAYLQMDSLKTEDTAVYYCTRWDGWSQHDYWGQGTLVTVSS | 262 | DIVMTQSPLSLSVTPGEPASISCRSSQSLLHSNGNNYFDWYLQKPGQSPQLLIYLASNRASGVPDRFSGSGSGTDFTLKISRVEAEDVGVYYCMQVLQIPYTFGQGTKLEI |
| | C573 | 6.2 m | 263 | QVQLQESGPGLVKPSGTLSLTCAVSGGSISTVNWWSWVRQPPGKGLEWIGEIHHSGNTNHNPSLRSRVTISVDKSKNQFSLKLRSVTAADTAVYYCARDGGRPGDAFDLWGQGTMVTVSS | 264 | QSALTQPASVSGSPGQSITISCTGTSSDVGGYNYVSWYQQHPGKVPKVMIYDVSNRPSGISNRFSGSKSGNTASLTISGLQAEDEADYYCNSYRSNSTRVFGTGTKVTV |

TABLE 4A-continued

Sequences of cloned recombinant antibodies

| Patient ID | Antibody ID | Time point | SEQ ID NO | IGH VDJ (aa) | SEQ ID NO | IGL VJ (aa) |
|---|---|---|---|---|---|---|
| | C574 | 1.3 m | 265 | QVQLVQSGAEVKKPGASVKVSCKASGYTFTSYGFSWVRQAPGQGLEWLGWISAYNGNTNYAQKLQGRVTMTTDTSTSTAYMELRSLRSDDTAVYYCARAIAVAGTSGEFDYWGQGTLVTVSS | 266 | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGHVVFGGGTKLTVL |
| | C575 | 6.2 m | 267 | QVQLVQSGAEVKKPGASVMLSCKASGYTFTSYGISWVRQAPGQGLEWMGWISAYNGNTNYAQKLQGRVSMTTDTSTSTAYMELRSLRSDDTAVYYCARAMAVAGTSGDFDYWGQGTLVTVSS | 268 | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGHVVFGGGTKLTVL |
| | C576 | 1.3 m | 269 | QVQLVQSGAEVKKPGSSVKVSCKASGGTFSIYAISWVRQAPGQGLEWMGGIIPILGTANYAQKFQGRVTITADESTSTAYMELSSLRSEDTAVYYCASFHVAYGDYIPFDYWGQGTLVTVSS | 270 | EIVLTQSPGTLSLSPGERATLSCRASQSVSSSYLAWYQQKPGQAPRLLIYGASSRATGIPDRFSGSGSGTDFTLTISRLEREDFAVYYCQQYGRSPTWTFGQGTKVEIK |
| | C577 | 6.2 m | 271 | QVQLVQSGAEVKKPGSSVKVSCKASGDTFSIYAFSWVRQAPGQGLQWMGAIIPLLGTTNYAQKFLGRVTITADESTSTTFMELSSLTSEDTAVYHCATFHVAYGDYIPFDSWGQGTLVIVSS | 272 | EIVLTQSPGTLSLSPGERATLSCRASQSVTSSYLAWYQQKPGQAPRLLIYGASSRATGIPDRFSGSGSGTDFTLTISRLEPEDFAVYYCQQYGRSPTWTFGQGTKVEIK |
| | C578 | 1.3 m | 273 | QVQLVESGGGVVQPGRSLRLSCAASGFTFSSSGMHWVRQAPGKGLEWVAIISYDGSNKYYADSVKGRFTISRDNSKNTLSLQMNSLRAEDTAVYYCAKDPLPFRDFFYYYMDVWGKGTTVTVSS | 274 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLGVFGTGTKVTVL |
| | C579 | 6.2 m | 275 | QVQLVESGGGVVQPGRSLRLSCAASGFTFSNYGMHLVRQAPGKGLEWVAIISYDGSNKYYADSVKGRFTISRDSSKNTLYLQMNNLRAEDTAVYYCAKDPLPFRDYYYYYMDVWGKGTTVTVSS | 276 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLGVFGTGTKVTVL |
| | C580 | 6.2 m | 277 | EVQLVQSGAEVKKAGESLKISCNSSGYSFTNYWIAWVRQVPGKGLEWMGIIYLGDSDTRYSPSFQGRVTISADKSISAAYLHWSSLKASDTAIYYCARGGPPGGVKLELTDFWGQGTLVTVSS | 278 | QSVLTQPPSASGTPGQRVTISCSGSNSNIGDNTVHWYQQLPGTAPKLLIFNNNQRPSGVPDRFSGSKSGTSASLAISGLQSDDEADYYCAAWDDSLDGPVVFGGGTKLTVL |
| | C581 | 1.3 m | 279 | EVQLVQSGAEVKKPGESLKISCKGSGYRFTSYWIAWVRQMPGKGLEWMGIIYPGDSDTRYSPSFQGQVTISADQSISTAYLQWSSLKASDTAMYYCARGGPPGGVKLELTDYWGQGALVTVSS | 280 | QSVLTQPPSASGTPGQRVTISCSGSSSNIGSNTVNWYQQLPGTAPQLLIYNNYQRPSGVPDRFSGSKSGTSASLAISGLQSEDEADYYCAAWDDSLNGPVVFGGGTKLTVL |
| | C582 | 6.2 m | 281 | QVQLVESGGGVVQPGRSLRLSCVASGFTFSYFDMHWVRQAPGKGLEWVALISHDGSTTFYGDSARGRFTISRDNSRNTLDLQMNSLRPEDTAVYFCAKPVDAAMFDFWGQGTLVTVS | 282 | SYELTQPPSVSVAPGKTARITCGGNNIGSKSVHWYQQRPGQAPVLVIYYDSDRPSGIPERFSGSNSGNTATLTISRVEAGDEADFYCQVWDRSTNHLVVFGGGTQLTVL |
| | C583 | 6.2 m | 283 | EVQLVESGGGLIQPGGSLRLSCAASILTVSRNYMSWVRQAPGKGLEWVSSIYSGGTTYYADSVKGRFTISRDDSKNTLYLQMNSLRAEDTAVYYCARPVVGGRAGMDVWGQGTTVTVSS | 284 | DIQMTQSPSSLSASVGDRVTITCQASQDINKYLNWYQQKPGKAPKLLIYDASNLETGVPSRFSGSGSGTDFTFTISSLQPEDIGTFYCLHNDNPPLTFGGGTKVEIK |
| | C584 | 6.2 m | 285 | EVQLVESGGGLVQPGGSLRLSCAASGFTFSTYDMHWVRQATGKGLEWVSAIGTAGDKYYPGSVKGRFTISRENAKNSLYLQMNSLRAGDTAVYYCVRAGYSSGWPLYWYFDLWGRGTLVTVSS | 286 | DIQMTQSPSSLSASVGDRVTITCRASQSISSYLNWYQQKPGKAPKFLIYAASSLQSGVPSRFSGSGSGTDFTLTISNLQPEDFATYYCQQSYRTPPEFTFGPGTKVDIK |

TABLE 4A-continued

Sequences of cloned recombinant antibodies

| Patient ID | Anti-body ID | Time point | SEQ ID NO | IGH VDJ (aa) | SEQ ID NO | IGL VJ (aa) |
|---|---|---|---|---|---|---|
| | C585 | 6.2 m | 287 | QVQLQESGPGLVKPSETLSLTCTVSGDSISSYFWSWIRQPPGRGLEWIGYIHDSVNTNYNPSLKSRVTISVDTSKSQFSLRLSSVTAADTAVYYCARCAWLRGSFDYWGQGTLVTVSS | 288 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDFSSHYVFGTGTKVTVL |
| | C586 | 6.2 m | 289 | EVQLVESGGGLIQPGGSLRLSCTASGLIVSSNYMSWIRQAPGKGLEWVSLIYSGGSTFYADSVKGRFTISRDNSKNTLFLHMNSLRAEDTAVYYCARHPYGTDVWGQGTTVTVSS | 290 | DIQMTQSPSSLSASVGDRVTITCQASQDIVKYLNWYQQKSGKAPKLLIHDASNLETGVTSRFSGSGSGTHFTFTISSLQPEDLATYYCQQYDNLPITFGQGTRLEIK |
| | C587 | 6.2 m | 291 | QVQLVQSGAEVKKSGSSVKVSCKASGGSFSSYAISWVRQAPGQGLEWMGGIIPIFGTAKYAQKFQGRVTITADESTSTAYMELSSLRSEDTAVYYCASRWEQLNGGSWHYFDYWGQGTLVTVSS | 292 | QSALTQPASVSGSPGQSITISCTGTRSDVGRNNLVSWYQHHPGKAPKVMIYEGSKRPSGVSTRFSGSKSGNTASLTISGLQAEDEADYYCCSYAGSSTFEGVFGGGTKLTVL |
| | C588 | 6.2 m | 293 | EVQLVESGGGLVQPGGSLKLSCAASGFTFSGSAMHWVRQASGKGLEWVGRIRNKANSYATAYGASVRGRFTVSRDDSKNTAYLQMNSLKIEDTAVYYCTKDIAAGIPALNWFDSWGQGTLVTVSS | 294 | EIVLTQSPATLSLSPGERATLSCRASQSVSSYLAWYQQKPGQAPRLLIYDASNRATGIPARFSGSGSGTDFTLTISSLEPEDFAVYYCQQHTNWPPRITFGGGTKVEIK |
| | C589 | 6.2 m | 295 | QVQLQESGPGLVKPSQTLSLTCTVSGGSISSGDYYWSWIRQPPGKGLEWIGYIYYSGSTNYNPSLRSRVTISVDTSKNQFSLRLRSVTAADTAVYYCARDAIGSASYGVEYFQHWGQGTLVTVSS | 296 | EIVLTQSPGTLSLSPGERATLSCRASQSVSSRYLAWYQQKPGQAPRLLIYGASSRATGIPDRFSGSGSGTEFTLTISRLEPEDFAVYYCQQYGSSPPYTFGQGTKLEIK |
| | C590 | 6.2 m | 297 | QVQLVQSGAEVKKPGASVKVSCKVSGYNLTELSMYWVRQAPGKGLEWMGGFDPEDGGPIHAQKFQGRVTMTEDPSTDTAYMELRSLRSEDTALYYCATGGLFMIRGLEIWGRGTLVTVSS | 298 | EIVLTQSPGTLSLSPGERATLSCRASQSISYTSLAWYQQKPGQAPRLLIFGASRGATGTPDRFSGSWSGTDFTLTISRLEPEDFAVYYCQQYGNSPRLSFGGGTKVEIK |
| | C591 | 1.3 m | 299 | QVQLVQSGAEVKKPGASVKVSCKASGYILTDYFIHWVRQAPGQGLEWMGWINPNSGGTNYAQKFQGRVTMTRDTSISTAYMELSRLRSDDTAVYHCARYKGTTVNTNYYYGMDVWGQGTTVTVSS | 300 | SYELTQPPSVSVSPGQTASITCSGDKLGDKYACWYQQKAGQSPVLVIYQDSKRPSGIPERFSGSKSGNTATLTISGTQAMDEADYYCQAWDSSTVVFGGGTKLTVL |
| | C592 | 6.2 m | 301 | QVQLVQSGAEVKKPGASVKVSCKASGYTFTDYFNHWVRQAPGQGLEWMGWINPNSGGTNSAQKFQGRVTMTRDTSITTVYMELSRLRSDDTAVYYCARYKGTTVNTNYYYGMDVWGQGTTVTVSS | 302 | SYELTQPPSVSVSPGQTASITCSGDKLRNKYACWYQQKAGQSPMLVIYQDTKRPSGIPERFSGSNSGNTATLTISGTQAMDEADYYCQAWDISTVVFGGGTKLTVL |
| | C593 | 6.2 m | 303 | QVQLVQSGAEVKKPGASVKVSCKASGYTFTSYDINWVRQAPGQGLEWMGWMNPNSGNTDYAQKFQGRFTMTRNTSISTAYMELSSLRSEDTAVYYCASRRWDPLTFYYYMVVWGKGTTVTVSS | 304 | DIVMTQSPLPLPVTPGEPASISCRSSQSLLYSNGYNYLDWYLQKPGQSPQLLIYLGSNRASGVPDRFSGSGSGTDFTLKISRVEAEDVGVYFCMQALQTPPTFGGGTKVEIK |
| | C594 | 1.3 m | 305 | QVQLVESGGGVVQPGRSLRLSCAASGFTFSSYGMHWVRQAPGKGLEWVAVISDDGSNKYYADSVKGRFTISRDNSKNTLYLQMNSLRAEDTAVYYCAKSWWLSENWFDPWGQGTLVTVSS | 306 | EIVMTQSPATLSVSPGERATLSCRASQSVSSNLAWYQQKPGQAPRLLIYGASTRATGIPARFSGTGSGTEFTLTISSLQSEDFAVYYCQQYNNWPLTFGGGTKVEIK |
| | C595 | 6.2 m | 307 | QVQLVESGGGVVQAGRSLRLSCAASGFTFSSFGLHWVRQAPGKGLEWVAVISDDGANKYYADSVKGRFTISRDNSKNTLYLQMNSLRADDTAKYYCAKSWWLSENWFDPWGQGTLVTVSS | 308 | EIVMTQSPATLSVSPGERATLSCRASQSVRSNLAWYQQKPGQAPRLLIYGASTRATGIPARFSGSGSGTDFTLTISSLQSEDFAVYYCQQYNNWPLTFGGGTKVEIK |

TABLE 4A-continued

Sequences of cloned recombinant antibodies

| Patient ID | Anti-body ID | Time point | SEQ ID NO | IGH VDJ (aa) | SEQ ID NO | IGL VJ (aa) |
|---|---|---|---|---|---|---|
| | C596 | 6.2 m | 309 | QVQLVESGGGVVQPGRSLRLSCAASGITFSHYGMHWVRQAPGKGLEWVALISSDGSKKYYADSVKGRFTISRDNSKSTLYLQMNSLRAEDTAIYYCAKDLGYYYGPPYGPDYWGQGTLVTVSS | 310 | DIQMTQSPSSLSASVGDRVTITCQASQDVSNSLNWYQQKPGKAPKLLIYDASNLETGVPSRFSGSGSGTDFSFTISSLQPEDIATYYCLQYDNFSMYTFGQGTKLEIK |
| | C032 | 1.3 m | 311 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGVAVDWYFDLWGRGTLVTVSS | 312 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALYVFGTGTKVTVL |
| | C132 | 1.3 m | 313 | QVQLQESGPGLVKPSGTLSLTCAVSGGSISSNNWWSCVRQPPGKGLEWIGEIYHSGSTNYNPSLKSRVTISVDKSKNQFSLKLSSVTAADTAVYYCARGGDTAMGPEYFDYWGQGTLVTVSS | 314 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLFGGGTKLTVL |
| | C143 | 1.3 m | 315 | EVQLVESGGGLVQPGGSLRLSCAASGFSVSTKYMTWVRQAPGKGLEWVSVLYSGGSDYYADSVKGRFTISRDNSKNALYLQMNSLRVEDTGVYYCARDSSEVRDHPGHPGRSVGAFDIWGQGTMVTVSS | 316 | QSALTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL |
| | C144 | 1.3 m | 317 | EVQLVESGGGLIQPGGSLRLSCAASGFTVSNNYMSWVRQAPGKGLEWVSVIYSGGSTYYADSVKGRFTISRDKSKNTLYLQMNRLRAEDTAVYYCAREGEVEGYNDFWSGYSRDRYYFDYWGQGTLVTVSS | 381 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL |
| | C512 | 6.2 m | 319 | QVQLQESGPGLVKPSGTLSLTCAVSAGSISSNNWWSWVRQPPGKGLEWIGEVYHNGNINYNPSLKSRVTLSVDKSKNQFSLKLSSVTAADTAVYYCAKGGDRAMGPEYFDSWGQGTLVTVSS | 320 | QSALTQPASVSGSPGQSITISCTGTSSDVGANNYVSWYQQHPGKAPKLMIYDVNERPSGVSNRFSGSKSGNTASLTISGLQTEDEADYYCSSFASSSTLLFGGGTKLTVL |
| | C164 | 1.3 m | 321 | EVQLVESGGGLVQPGGSLRLSCAASGFSVSTKYMTWVRQAPGKGLEWVSVLYSGGSDYYADSVKGRFTISRDNSKNALYLQMNSLRVEDTGVYYCARDSSEVRDHPGHPGRSVGAFDIWGQGTMVTVSS | 322 | QSALTQPASVSGSPGQSITISCTGTSNDVGSYTLVSWYQQYPGKAPKLLIFEVTKRSSGISNRFSGSKSGNTASLTISGLQGEDEADYYCCSYAGASTFVFGGGTKLTVL |

TABLE 4B

| Patient ID | Antibody ID | EC$_{50}$ [ng/ml] RBD | R346S | E484K | Q493R | N439K | N440K | A475V |
|---|---|---|---|---|---|---|---|---|
| COV47 | C050 | 1.93 | 1.67 | >10000 | 1.45 | 1.47 | 1.79 | 1.68 |
| | C051 | 1.65 | 2.30 | 200.40 | 1.46 | 1.63 | 2.09 | 1.57 |
| | C052 | 1.23 | 1.30 | >10000 | 12.15 | 1.52 | 1.65 | 1.41 |
| | C053 | 1.53 | 1.57 | >10000 | 2.12 | 1.65 | 1.82 | 1.61 |
| | C054 | 1.58 | 1.59 | >10000 | >10000 | 1.92 | 1.86 | 1.82 |
| | C055 | 1.25 | 1.30 | 3.15 | 1.27 | 1.47 | 1.35 | 1.23 |
| | C057 | 2.31 | 2.43 | >10000 | 9.78 | 1.72 | 1.83 | 1.83 |
| | C058 | 2.28 | 2.62 | >10000 | 601.30 | 2.36 | 2.71 | 2.27 |
| | C059 | 1.88 | 2.27 | >10000 | 4.37 | 5.69 | 1.63 | 1.69 |
| | C060 | 43.54 | 22.02 | 4040.00 | 4328.00 | 111.70 | 773.50 | >10000 |
| | C062 | 4.69 | 9.39 | 127.50 | 10.84 | 17.40 | 26.93 | 64.52 |
| | C063 | 414.00 | n.d. | n.d. | n.d. | n.d. | n.d. | n.d. |
| | C064 | 362.70 | n.d. | n.d. | n.d. | n.d. | n.d. | n.d. |
| | C065 | 29.13 | n.d. | n.d. | n.d. | n.d. | n.d. | n.d. |
| | C066 | 4.20 | n.d. | n.d. | n.d. | n.d. | n.d. | n.d. |
| | C067 | 6.98 | n.d. | n.d. | n.d. | n.d. | n.d. | n.d. |
| | C068 | 5.46 | n.d. | n.d. | n.d. | n.d. | n.d. | n.d. |
| | C069 | 381.40 | n.d. | n.d. | n.d. | n.d. | n.d. | n.d. |
| | C081 | 12.47 | 6.85 | 6.51 | 8.36 | 6.84 | 4.14 | 6.13 |
| | C083 | 25.12 | n.d. | n.d. | n.d. | n.d. | n.d. | n.d. |
| | C085 | 2.38 | 2.73 | 4.30 | >10000 | 3.72 | 3.93 | 2.55 |
| | C086 | 3.01 | 3.08 | 5.36 | 456.00 | 3.18 | 2.87 | 2.68 |
| | C088 | 2.44 | n.d. | n.d. | n.d. | n.d. | n.d. | n.d. |
| | C089 | 4.69 | 9.32 | >10000 | 11.64 | 40.61 | 49.85 | 58.56 |
| | C090 | 6.22 | 11.82 | 40.01 | 18.65 | 31.23 | 100.20 | 42.96 |
| | C518 | 1.13 | n.d. | n.d. | n.d. | n.d. | n.d. | n.d. |
| | C519 | 1.07 | n.d. | n.d. | n.d. | n.d. | n.d. | n.d. |
| COV72 | C501 | >10000 | n.d. | n.d. | n.d. | n.d. | n.d. | n.d. |
| | C502 | 6.48 | n.d. | n.d. | n.d. | n.d. | n.d. | n.d. |
| | C503 | 6.55 | n.d. | n.d. | n.d. | n.d. | n.d. | n.d. |
| | C504 | 9.08 | n.d. | n.d. | n.d. | n.d. | n.d. | n.d. |
| | C505 | 15.98 | n.d. | n.d. | n.d. | n.d. | n.d. | n.d. |
| | C506 | 5.94 | n.d. | n.d. | n.d. | n.d. | n.d. | n.d. |
| | C507 | 5.60 | n.d. | n.d. | n.d. | n.d. | n.d. | n.d. |
| | C508 | >10000 | n.d. | n.d. | n.d. | n.d. | n.d. | n.d. |
| | C509 | 4.44 | n.d. | n.d. | n.d. | n.d. | n.d. | n.d. |
| | C510 | 308.50 | n.d. | n.d. | n.d. | n.d. | n.d. | n.d. |
| | C511 | 1.33 | 0.96 | 1.24 | 1.43 | 0.91 | 1.21 | 1.27 |
| | C512 | 1.68 | 2.13 | 1.43 | 1.63 | 1.38 | 1.60 | 1.68 |
| | C513 | 1.31 | 0.99 | 1.42 | 1.21 | 1.31 | 1.28 | 1.40 |
| | C514 | 0.82 | 0.98 | 0.87 | 0.94 | 0.98 | 1.07 | 0.93 |
| | C515 | 1.73 | 1.35 | 2.49 | 3.49 | 1.44 | 1.60 | 10.72 |
| | C516 | 5.72 | n.d. | n.d. | n.d. | n.d. | n.d. | n.d. |
| | C517 | 0.87 | 1.03 | 1.19 | 1.20 | 1.26 | 1.39 | 1.25 |
| | C597 | 3.77 | 2.45 | 4.42 | 4.20 | 2.08 | 1.95 | 2.57 |
| | C598 | 3.78 | 2.57 | 3.16 | 3.02 | 2.06 | 2.08 | 2.45 |
| COV96 | C523 | 9.08 | n.d. | n.d. | n.d. | n.d. | n.d. | n.d. |
| | C524 | 5.00 | n.d. | n.d. | n.d. | n.d. | n.d. | n.d. |
| | C525 | 10.56 | n.d. | n.d. | n.d. | n.d. | n.d. | n.d. |
| | C526 | 18.25 | n.d. | n.d. | n.d. | n.d. | n.d. | n.d. |
| | C527 | 13.44 | n.d. | n.d. | n.d. | n.d. | n.d. | n.d. |
| | C528 | 5.66 | n.d. | n.d. | n.d. | n.d. | n.d. | n.d. |
| | C529 | 8.00 | n.d. | n.d. | n.d. | n.d. | n.d. | n.d. |
| | C530 | 10.46 | n.d. | n.d. | n.d. | n.d. | n.d. | n.d. |
| | C531 | 6.84 | n.d. | n.d. | n.d. | n.d. | n.d. | n.d. |
| | C532 | 1.00 | 1.15 | 1.36 | 2.80 | 4.44 | 3.98 | 18.92 |
| | C533 | 1.61 | n.d. | n.d. | n.d. | n.d. | n.d. | n.d. |
| | C534 | 4.85 | n.d. | n.d. | n.d. | n.d. | n.d. | n.d. |
| | C535 | 2.46 | n.d. | n.d. | n.d. | n.d. | n.d. | n.d. |
| | C536 | 1.88 | n.d. | n.d. | n.d. | n.d. | n.d. | n.d. |
| | C537 | 41.85 | n.d. | n.d. | n.d. | n.d. | n.d. | n.d. |
| | C538 | 3.95 | n.d. | n.d. | n.d. | n.d. | n.d. | n.d. |
| | C539 | 1.30 | 1.16 | 1.79 | 1.37 | 1.41 | 1.79 | 1.49 |
| | C540 | 2.90 | 1.72 | 2.32 | 1.77 | 1.78 | 2.62 | 1.96 |
| | C542 | 1.07 | 1.08 | 0.69 | 1.80 | 1.76 | 1.55 | 2.33 |
| | C543 | 1.28 | 1.41 | 1.23 | 3.84 | 4.64 | 2.78 | 2.23 |
| | C544 | 2.34 | 2.05 | 2.73 | 2.09 | 2.15 | 2.85 | 2.21 |
| | C545 | 3.68 | 1.84 | 2.07 | 1.54 | 3.43 | 2.74 | 2.62 |
| | C546 | 3.57 | 2.28 | 2.44 | 10.79 | 24.50 | 25.91 | 38.13 |
| | C547 | 1.78 | 1.88 | 2.81 | 11.65 | 19.19 | 17.39 | 4.99 |
| | C548 | 1.72 | 1.94 | >10000 | 49.38 | 1.78 | 1.55 | 1.68 |
| | C549 | 1.76 | 1.91 | 1.48 | 1.48 | 2.13 | 2.61 | 2.40 |
| | C550 | 2.56 | 2.77 | 6.18 | 6.26 | 11.40 | 7.48 | 20.44 |
| | C552 | 1.08 | 1.16 | 1.14 | 1.41 | 1.37 | 2.17 | 1.77 |
| | C553 | 1.19 | 1.27 | 1.13 | 1.77 | 1.73 | 2.48 | 2.11 |

TABLE 4B-continued

| | | | | | | | | |
|---|---|---|---|---|---|---|---|---|
| | C554 | 8.20 | 2.36 | 7.01 | >10000 | 11.96 | 19.72 | 32.37 |
| | C555 | 2.88 | 1.63 | 2.32 | 3.42 | 4.28 | 4.79 | 6.13 |
| | C556 | 1.36 | 1.88 | 2.29 | 1.35 | 1.53 | 1.44 | 1.24 |
| | C557 | 2.18 | 1.25 | 2.26 | 1.24 | 1.69 | 2.01 | 1.34 |
| | C558 | 2.41 | 1.58 | 1.56 | 24.28 | 5.10 | 16.29 | 1.13 |
| | C559 | 2.89 | 1.96 | 2.00 | 44.53 | 4.09 | >10000 | 3.47 |
| | C560 | 1.60 | 1.23 | 2.14 | 4.08 | 5.07 | 6.09 | 7.02 |
| | C561 | 1.53 | 0.89 | 1.09 | 2.56 | 2.72 | 2.48 | 2.86 |
| | C562 | 2.55 | n.d. | n.d. | n.d. | n.d. | n.d. | n.d. |
| | C563 | 1.19 | n.d. | n.d. | n.d. | n.d. | n.d. | n.d. |
| | C564 | 14.64 | 6.59 | 9.81 | 251.10 | 233.20 | 2113.00 | 396.90 |
| | C213 | 2.02 | 1.59 | 1.87 | 1.31 | 1.79 | 1.61 | 1.54 |
| | C217 | 2.28 | 1.68 | 1.94 | 1.78 | 1.81 | 1.80 | 1.57 |
| COV57 | C070 | >10000 | n.d. | n.d. | n.d. | n.d. | n.d. | n.d. |
| | C073 | 20.61 | n.d. | n.d. | n.d. | n.d. | n.d. | n.d. |
| | C075 | >10000 | n.d. | n.d. | n.d. | n.d. | n.d. | n.d. |
| | C077 | 45.95 | n.d. | n.d. | n.d. | n.d. | n.d. | n.d. |
| | C078 | 3859.00 | n.d. | n.d. | n.d. | n.d. | n.d. | n.d. |
| | C079 | >10000 | n.d. | n.d. | n.d. | n.d. | n.d. | n.d. |
| | C080 | 1.97 | 1.74 | 2.66 | 2.00 | 2.27 | 2.28 | 2.60 |
| | C091 | 89.45 | 3.53 | 8.09 | 3.76 | 3.04 | 23.38 | 4.28 |
| | C092 | 7.07 | 2.78 | 3.14 | 3.14 | 2.41 | 3.22 | 2.92 |
| | C093 | 1.02 | 0.88 | 37.05 | 235.60 | 2.92 | 3.20 | 2.35 |
| | C094 | 1.67 | 1.56 | 244.90 | 931.60 | 2.83 | 2.46 | 1.97 |
| | C034 | 15.67 | n.d. | n.d. | n.d. | n.d. | n.d. | n.d. |
| | C035 | 15.16 | n.d. | n.d. | n.d. | n.d. | n.d. | n.d. |
| | C520 | >10000 | n.d. | n.d. | n.d. | n.d. | n.d. | n.d. |
| | C521 | 6.90 | n.d. | n.d. | n.d. | n.d. | n.d. | n.d. |
| | C522 | 0.93 | n.d. | n.d. | n.d. | n.d. | n.d. | n.d. |
| COV21 | C095 | 1.10 | 1.05 | >10000 | 1.53 | 1.44 | 1.06 | 1.08 |
| | C096 | 5.18 | n.d. | n.d. | n.d. | n.d. | n.d. | n.d. |
| | C097 | 3.45 | 2.70 | 3.58 | 4.88 | 2.83 | 2.23 | 2.37 |
| | C098 | 7.70 | 12.94 | 676.50 | 1402.00 | 49.69 | 20.56 | >10000 |
| | C099 | 2.45 | 2.25 | 7.61 | 3.95 | 1.85 | 1.94 | 1.83 |
| | C043 | 12.13 | 11.20 | 18.77 | 1.35 | 1.89 | 1.45 | 1.37 |
| | C044 | 1821.00 | 2.89 | 2747.00 | 2.20 | 2.62 | 40.21 | 94.12 |
| | C045 | 7.00 | 1.77 | 4.16 | 1.74 | 4.84 | 3.58 | 4.04 |
| | C046 | 4.02 | n.d. | n.d. | n.d. | n.d. | n.d. | n.d. |
| | C047 | 11.10 | n.d. | n.d. | n.d. | n.d. | n.d. | n.d. |
| | C048 | 4.80 | 5.02 | 17.10 | 6.93 | 3.74 | 4.09 | 3.89 |
| | C049 | 4.09 | 4.78 | 7.73 | 4.79 | 3.27 | 2.76 | 3.32 |
| | C710 | 17.80 | n.d. | n.d. | n.d. | n.d. | n.d. | n.d. |
| | C703 | 10.95 | n.d. | n.d. | n.d. | n.d. | n.d. | n.d. |
| | C704 | 13.38 | n.d. | n.d. | n.d. | n.d. | n.d. | n.d. |
| | C706 | 73.48 | n.d. | n.d. | n.d. | n.d. | n.d. | n.d. |
| | C707 | 25.99 | n.d. | n.d. | n.d. | n.d. | n.d. | n.d. |
| | C708 | 130.00 | n.d. | n.d. | n.d. | n.d. | n.d. | n.d. |
| | C709 | 7.56 | n.d. | n.d. | n.d. | n.d. | n.d. | n.d. |
| COV107 | C565 | 1.27 | n.d. | n.d. | n.d. | n.d. | n.d. | n.d. |
| | C566 | 5.88 | n.d. | n.d. | n.d. | n.d. | n.d. | n.d. |
| | C567 | 18.90 | n.d. | n.d. | n.d. | n.d. | n.d. | n.d. |
| | C568 | 5.99 | n.d. | n.d. | n.d. | n.d. | n.d. | n.d. |
| | C569 | 11.05 | n.d. | n.d. | n.d. | n.d. | n.d. | n.d. |
| | C570 | 0.74 | n.d. | n.d. | n.d. | n.d. | n.d. | n.d. |
| | C571 | 4.63 | 2.83 | 26.56 | 1.93 | 4.10 | 4.78 | >10000 |
| | C572 | 2.90 | 2.43 | 3974.00 | 297.40 | 2.02 | 1.46 | 2.20 |
| | C573 | 2.20 | 3555.00 | 5.57 | 2.27 | 1.90 | 1.61 | 2.09 |
| | C574 | 8.12 | >10000 | >10000 | 2.61 | 5.39 | >10000 | 4.68 |
| | C575 | 6.09 | >10000 | >10000 | 2.89 | 5.50 | >10000 | 4.40 |
| | C576 | 5.29 | 2.79 | 7.88 | 2.68 | 3.07 | 4.37 | 2.63 |
| | C577 | 1.32 | 0.70 | 1.97 | 1.87 | 1.84 | 1.89 | 1.66 |
| | C578 | 1.08 | 1.27 | 136.70 | >10000 | 1.32 | 1.69 | 1.39 |
| | C579 | 3.48 | 2.37 | 2108.00 | >10000 | 3.30 | 4.20 | 3.37 |
| | C580 | 1.82 | 1.69 | 2.50 | 1.83 | 2.21 | 1.93 | 1.99 |
| | C581 | 1.58 | 3.04 | 2.75 | 1.53 | 1.77 | 1.81 | 1.74 |
| | C582 | 8.43 | n.d. | n.d. | n.d. | n.d. | n.d. | n.d. |
| | C583 | 4.42 | n.d. | n.d. | n.d. | n.d. | n.d. | n.d. |
| | C584 | 10.50 | n.d. | n.d. | n.d. | n.d. | n.d. | n.d. |
| | C585 | 11.00 | n.d. | n.d. | n.d. | n.d. | n.d. | n.d. |
| | C586 | 5.42 | n.d. | n.d. | n.d. | n.d. | n.d. | n.d. |
| | C587 | 4.39 | n.d. | n.d. | n.d. | n.d. | n.d. | n.d. |
| | C588 | 1.36 | n.d. | n.d. | n.d. | n.d. | n.d. | n.d. |
| | C589 | 6.61 | n.d. | n.d. | n.d. | n.d. | n.d. | n.d. |
| | C590 | 2.81 | n.d. | n.d. | n.d. | n.d. | n.d. | n.d. |
| | C591 | 3.83 | 3.95 | >10000 | 5.37 | 5.26 | 4.30 | 4.21 |
| | C592 | 6.00 | 6.34 | >10000 | 5.87 | 4.48 | 5.83 | 5.04 |
| | C593 | 4.36 | n.d. | n.d. | n.d. | n.d. | n.d. | n.d. |

TABLE 4B-continued

| | | | | | | | |
|---|---|---|---|---|---|---|---|
| C594 | 2.63 | 6.30 | 37.37 | 1.76 | 17.83 | 7.23 | 2.05 |
| C595 | 2.04 | 1.67 | 4.49 | 1.03 | 9.20 | 3.19 | 2.30 |
| C596 | 21.02 | n.d. | n.d. | n.d. | n.d. | n.d. | n.d. |

| Patient ID | Antibody ID | $EC_{50}$ [ng/ml] | | | Neutralization | |
|---|---|---|---|---|---|---|
| | | S477N | V483A | V367F | IC50 [ng/ml] | IC90 [ng/ml] |
| COV47 | C050 | 1.51 | 1.88 | 1.78 | 12.92 | 28.41 |
| | C051 | 1.70 | 1.98 | 2.01 | 12.51 | 91.69 |
| | C052 | 1.52 | 1.42 | 1.53 | 4.89 | 27.79 |
| | C053 | 1.56 | 1.83 | 1.63 | 8.23 | 39.80 |
| | C054 | 1.60 | 1.73 | 1.54 | 4.84 | 15.45 |
| | C055 | 1.16 | 1.54 | 1.28 | 6.40 | 36.83 |
| | C057 | 1.40 | 2.00 | 1.96 | 2.78 | 33.59 |
| | C058 | 1.93 | 2.85 | 2.31 | 5.28 | 31.55 |
| | C059 | 1.52 | 2.04 | 1.93 | 8.35 | 24.49 |
| | C060 | 38.21 | 1413.00 | 7849.00 | >10000 | >10000 |
| | C062 | 5.70 | 5.55 | 3.90 | 703.61 | >10000 |
| | C063 | n.d. | n.d. | n.d. | >10000 | >10000 |
| | C064 | n.d. | n.d. | n.d. | 3053.48 | >10000 |
| | C065 | n.d. | n.d. | n.d. | 2746.14 | >10000 |
| | C066 | n.d. | n.d. | n.d. | 22.80 | 136.01 |
| | C067 | n.d. | n.d. | n.d. | 87.33 | 350.23 |
| | C068 | n.d. | n.d. | n.d. | 54.70 | 114.53 |
| | C069 | n.d. | n.d. | n.d. | 10.04 | 99.15 |
| | C081 | 7.24 | 8.33 | 6.11 | 309.73 | >10000 |
| | C083 | n.d. | n.d. | n.d. | 253.56 | >10000 |
| | C085 | 2.19 | 2.18 | 1.97 | 17.18 | 76.89 |
| | C086 | 2.61 | 2.85 | 2.39 | 7.02 | 40.88 |
| | C088 | n.d. | n.d. | n.d. | 14.54 | 47.15 |
| | C089 | 10.00 | 10.74 | 125.30 | >10000 | >10000 |
| | C090 | 10.51 | 9.70 | 84.08 | >10000 | >10000 |
| | C518 | n.d. | n.d. | n.d. | 31.03 | 78.53 |
| | C519 | n.d. | n.d. | n.d. | 23.81 | 192.33 |
| COV72 | C501 | n.d. | n.d. | n.d. | >10000 | >10000 |
| | C502 | n.d. | n.d. | n.d. | 12.49 | 38.46 |
| | C503 | n.d. | n.d. | n.d. | 21.57 | 81.32 |
| | C504 | n.d. | n.d. | n.d. | >10000 | >10000 |
| | C505 | n.d. | n.d. | n.d. | 234.42 | >10000 |
| | C506 | n.d. | n.d. | n.d. | >10000 | >10000 |
| | C507 | n.d. | n.d. | n.d. | 1102.33 | >10000 |
| | C508 | n.d. | n.d. | n.d. | >10000 | >10000 |
| | C509 | n.d. | n.d. | n.d. | 14.21 | 112.09 |
| | C510 | n.d. | n.d. | n.d. | >10000 | >10000 |
| | C511 | 0.96 | 1.13 | 1.12 | 28.83 | 89.14 |
| | C512 | 1.46 | 1.79 | 1.87 | 52.23 | 274.99 |
| | C513 | 1.12 | 1.04 | 1.11 | 12.86 | 88.44 |
| | C514 | 0.98 | 1.02 | 1.21 | 22.28 | 86.32 |
| | C515 | 1.28 | 1.43 | 1.55 | 11.04 | 51.00 |
| | C516 | n.d. | n.d. | n.d. | 8.85 | 35.24 |
| | C517 | 1.24 | 1.29 | 1.44 | 11.31 | 49.51 |
| | C597 | 2.01 | 2.17 | 2.19 | 5.09 | 20.05 |
| | C598 | 2.16 | 2.27 | 2.21 | 7.12 | 31.29 |
| COV96 | C523 | n.d. | n.d. | n.d. | 973.58 | >10000 |
| | C524 | n.d. | n.d. | n.d. | 8.01 | 38.55 |
| | C525 | n.d. | n.d. | n.d. | 317.73 | 3940.15 |
| | C526 | n.d. | n.d. | n.d. | 412.25 | >10000 |
| | C527 | n.d. | n.d. | n.d. | 917.08 | >10000 |
| | C528 | n.d. | n.d. | n.d. | 4005.30 | >10000 |
| | C529 | n.d. | n.d. | n.d. | 577.95 | 5512.55 |
| | C530 | n.d. | n.d. | n.d. | 1068.11 | >10000 |
| | C531 | n.d. | n.d. | n.d. | 55.18 | 719.62 |
| | C532 | 3.00 | 4.36 | 6.28 | 116.15 | 1779.53 |
| | C533 | n.d. | n.d. | n.d. | 14.15 | 98.87 |
| | C534 | n.d. | n.d. | n.d. | >10000 | >10000 |
| | C535 | n.d. | n.d. | n.d. | 372.46 | >10000 |
| | C536 | n.d. | n.d. | n.d. | 91.11 | 837.79 |
| | C537 | n.d. | n.d. | n.d. | >10000 | >10000 |
| | C538 | n.d. | n.d. | n.d. | >10000 | >10000 |
| | C539 | 1.43 | 1.60 | 1.92 | 657.71 | >10000 |
| | C540 | 1.88 | 2.43 | 2.39 | 7379.68 | >10000 |
| | C542 | 1.47 | 1.42 | 1.38 | 16.46 | 97.25 |
| | C543 | 1.66 | 2.28 | 1.85 | 1389.22 | >10000 |
| | C544 | 2.00 | 2.33 | 2.37 | 2413.78 | >10000 |
| | C545 | 1.38 | 1.19 | 1.66 | 2711.36 | >10000 |
| | C546 | 10.85 | 12.37 | 8.97 | >10000 | >10000 |
| | C547 | 3.08 | 4.12 | 4.02 | 5301.94 | >10000 |

TABLE 4B-continued

| | | | | | | |
|---|---|---|---|---|---|---|
| | C548 | 1.49 | 1.35 | 1.45 | 30.51 | 207.19 |
| | C549 | 2.29 | 2.34 | 2.64 | 14.07 | 32.09 |
| | C550 | 7.27 | 6.83 | 48.37 | >10000 | >10000 |
| | C552 | 1.48 | 1.91 | 1.99 | 3095.35 | >10000 |
| | C553 | 1.90 | 2.28 | 2.38 | 687.37 | >10000 |
| | C554 | 10.86 | 5.70 | 7.51 | >10000 | >10000 |
| | C555 | 4.34 | 4.18 | 5.22 | 276.16 | >10000 |
| | C556 | 1.12 | 1.10 | 0.81 | 47.18 | 738.16 |
| | C557 | 1.18 | 0.95 | 0.92 | 21.52 | 2070.32 |
| | C558 | 1.03 | >10000 | 1.06 | >10000 | >10000 |
| | C559 | 1.37 | >10000 | 2.90 | 613.04 | >10000 |
| | C560 | 4.20 | 3.67 | 4.28 | 145.86 | 1947.93 |
| | C561 | 2.87 | 3.17 | 3.19 | 47.02 | 197.28 |
| | C562 | n.d. | n.d. | n.d. | 2552.29 | >10000 |
| | C563 | n.d. | n.d. | n.d. | 4.51 | 22.94 |
| | C564 | 44.26 | 38.27 | 39.96 | >10000 | >10000 |
| | C213 | 1.42 | 1.17 | 1.38 | 2128.97 | >10000 |
| | C217 | 1.47 | 1.25 | 1.48 | 8055.33 | >10000 |
| COV57 | C070 | n.d. | n.d. | n.d. | >10000 | >10000 |
| | C073 | n.d. | n.d. | n.d. | >10000 | >10000 |
| | C075 | n.d. | n.d. | n.d. | >10000 | >10000 |
| | C077 | n.d. | n.d. | n.d. | >10000 | >10000 |
| | C078 | n.d. | n.d. | n.d. | >10000 | >10000 |
| | C079 | n.d. | n.d. | n.d. | >10000 | >10000 |
| | C080 | 2.27 | 2.22 | 2.44 | 44.28 | 1888.45 |
| | C091 | 3.47 | 117.90 | 25.24 | 56.67 | 630.92 |
| | C092 | 2.70 | 3.09 | 3.78 | 227.25 | >10000 |
| | C093 | 2.42 | 3.19 | 2.51 | 22.80 | 81.34 |
| | C094 | 2.08 | 2.29 | 2.44 | 470.54 | 1472.13 |
| | C034 | n.d. | n.d. | n.d. | 1689.38 | >10000 |
| | C035 | n.d. | n.d. | n.d. | >10000 | >10000 |
| | C520 | n.d. | n.d. | n.d. | >10000 | >10000 |
| | C521 | n.d. | n.d. | n.d. | 11.30 | 61.22 |
| | C522 | n.d. | n.d. | n.d. | 20.64 | 73.97 |
| COV21 | C095 | 1.15 | 0.94 | 1.07 | 11.28 | 52.56 |
| | C096 | n.d. | n.d. | n.d. | 80.20 | 349.01 |
| | C097 | 2.35 | 2.12 | 2.45 | 9.60 | 31.11 |
| | C098 | 6.35 | 9.39 | 5.39 | 478.60 | 4246.68 |
| | C099 | 1.64 | 1.55 | 1.54 | 27.23 | 86.08 |
| | C043 | 1.52 | 1.35 | 1.52 | 10.56 | 74.43 |
| | C044 | 2.13 | 2.64 | 2.53 | >10000 | >10000 |
| | C045 | 1.61 | 1.74 | 1.77 | >10000 | >10000 |
| | C046 | n.d. | n.d. | n.d. | 8.69 | 52.59 |
| | C047 | n.d. | n.d. | n.d. | >10000 | >10000 |
| | C048 | 3.38 | 3.99 | 3.14 | 62.20 | 522.84 |
| | C049 | 2.41 | 2.83 | 3.05 | 18.12 | 129.11 |
| | C710 | n.d. | n.d. | n.d. | >10000 | >10000 |
| | C703 | n.d. | n.d. | n.d. | 681.46 | >10000 |
| | C704 | n.d. | n.d. | n.d. | >10000 | >10000 |
| | C706 | n.d. | n.d. | n.d. | 2030.41 | >10000 |
| | C707 | n.d. | n.d. | n.d. | >10000 | >10000 |
| | C708 | n.d. | n.d. | n.d. | 488.95 | 8858.44 |
| | C709 | n.d. | n.d. | n.d. | 406.54 | >10000 |
| COV107 | C565 | n.d. | n.d. | n.d. | 25.58 | 77.59 |
| | C566 | n.d. | n.d. | n.d. | 129.68 | 1776.43 |
| | C567 | n.d. | n.d. | n.d. | >10000 | >10000 |
| | C568 | n.d. | n.d. | n.d. | >10000 | >10000 |
| | C569 | n.d. | n.d. | n.d. | 2427.93 | >10000 |
| | C570 | n.d. | n.d. | n.d. | 207.05 | >10000 |
| | C571 | 3.79 | 3.51 | 3.28 | 326.24 | 2134.35 |
| | C572 | 1.49 | 3.19 | 1.72 | 72.63 | 1800.09 |
| | C573 | 1.36 | 1.40 | 1.54 | 13.41 | 117.64 |
| | C574 | 2.63 | 3.02 | 2.71 | >10000 | >10000 |
| | C575 | 2.39 | 2.66 | 2.31 | 5394.51 | >10000 |
| | C576 | 2.61 | 2.54 | 2.27 | 16.19 | 312.74 |
| | C577 | 1.70 | 1.79 | 1.83 | 419.38 | >10000 |
| | C578 | 1.56 | 1.52 | 1.64 | 13.27 | 150.36 |
| | C579 | 2.93 | 3.79 | 3.20 | 154.75 | 1054.97 |
| | C580 | 2.03 | 1.75 | 2.11 | 116.79 | 575.02 |
| | C581 | 1.84 | 1.59 | 4.26 | 31.57 | 351.60 |
| | C582 | n.d. | n.d. | n.d. | 161.62 | 2079.03 |
| | C583 | n.d. | n.d. | n.d. | 37.71 | 103.79 |
| | C584 | n.d. | n.d. | n.d. | 3453.82 | >10000 |
| | C585 | n.d. | n.d. | n.d. | 222.00 | 1198.28 |
| | C586 | n.d. | n.d. | n.d. | 45.20 | 126.36 |
| | C587 | n.d. | n.d. | n.d. | 6.17 | 31.00 |
| | C588 | n.d. | n.d. | n.d. | 12.00 | 122.24 |
| | C589 | n.d. | n.d. | n.d. | 227.05 | 2760.53 |
| | C590 | n.d. | n.d. | n.d. | 96.65 | 425.47 |
| | C591 | 3.15 | 3.66 | 3.26 | 245.65 | 2213.79 |

TABLE 4B-continued

| | | | | | |
|---|---|---|---|---|---|
| C592 | 5.10 | 5.37 | 5.58 | 18.96 | 160.71 |
| C593 | n.d. | n.d. | n.d. | 10.24 | 45.28 |
| C594 | 1.78 | 2.01 | 1.84 | 158.54 | 855.34 |
| C595 | 1.95 | 2.08 | 1.85 | 53.21 | 636.88 |
| C596 | n.d. | n.d. | n.d. | 965.51 | >10000 |

To determine whether the antibodies expressed by memory B cells at the late time point also showed altered breadth, we compared them to earlier clonal relatives in binding assays using control and mutant RBDs: The mutations E484K and Q493R were selected for resistance to class 2 antibodies such as C144 and C121 that bind directly to the ACE2 interaction ridge in the RBD, while R346S, N439K, and N440K were selected for resistance to class 3 antibodies such as C135 that do not directly interfere with ACE-2 binding (FIG. 3*c*). In addition, V367F, A475V, S477N, and V483A represent circulating variants that confer complete or partial resistance to class 1 and 2 antibodies (FIG. 3*c*). Out of 45 paired singlets and clones appearing at both time points, 38 (80%) showed increased binding to mutant RBDs at the 6.2 month time point (FIGS. 11*b-j*, Table 5). For example, C144, an antibody recovered at the 1.3 month time point, was unable to bind to Q493R or E484K RBDs, but all 4 of its 6.2 month clonal derivatives bound to Q493R, and one also showed binding to E484K (FIG. 3*d*). Overall, the most pronounced increase in binding occurred for RBD mutations in amino acid positions such as E484, Q493, N439, N440, and R346 that are critical for binding of class 2 and 3 antibodies (FIG. 3*e*, FIGS. 11*b-j*, and Table 5).

TABLE 5 mAb EC50s

| Patient | | Antibody | Epitope $EC_{50}$ (ng/ml) RBD | R346S | E484K | Q493R | N439K | N440K |
|---|---|---|---|---|---|---|---|---|
| 21 | shared clones | C005 (1.3 m) | 2.846 | 2.838 | >10000 | 4.534 | 1.897 | 1.649 |
| | | C043 (6.2 m) | 12.13 | 11.2 | 18.77 | 1.347 | 1.891 | 1.446 |
| | | C002 (1.3 m) | 1.983 | 2.108 | >10000 | 2823 | 1.806 | 1.283 |
| | | C095 (6.2 m) | 1.097 | 1.045 | >10000 | 1.53 | 1.442 | 1.059 |
| | | C021 (1.3 m) | 4.192 | 4.698 | 87.2 | >10000 | 30.24 | 8.461 |
| | | C097 (6.2 m) | 3.447 | 2.698 | 3.583 | 4.876 | 2.829 | 2.233 |
| | shared singlets | C048 (1.3 m) | 4.804 | 5.023 | 17.1 | 6.931 | 3.743 | 4.085 |
| | | C049 (6.2 m) | 4.086 | 4.778 | 7.733 | 4.794 | 3.273 | 2.755 |
| | | C044 (1.3 m) | 1821 | 2.893 | 2747 | 2.204 | 2.62 | 40.21 |
| | | C045 (6.2 m) | 7.002 | 1.772 | 4.159 | 1.744 | 4.835 | 3.584 |
| | | C098 (1.3 m) | 7.698 | 12.94 | 676.5 | 1402 | 49.69 | 20.56 |
| | | C099 (6.2 m) | 2.446 | 2.245 | 7.614 | 3.952 | 1.853 | 1.941 |
| | new clones | C047 (6.2 m) | 11.1 | n.d. | n.d. | n.d. | n.d. | n.d. |
| | randomly selected | C046 (6.2 m) | 4.02 | n.d. | n.d. | n.d. | n.d. | n.d. |
| | | C096 (6.2 m) | 5.18 | n.d. | n.d. | n.d. | n.d. | n.d. |
| | | C703 (6.2 m) | 10.95 | n.d. | n.d. | n.d. | n.d. | n.d. |
| | | C704 (6.2 m) | 13.38 | n.d. | n.d. | n.d. | n.d. | n.d. |
| | | C706 (6.2 m) | 73.48 | n.d. | n.d. | n.d. | n.d. | n.d. |
| | | C707 (6.2 m) | 25.99 | n.d. | n.d. | n.d. | n.d. | n.d. |
| | | C708 (6.2 m) | 130 | n.d. | n.d. | n.d. | n.d. | n.d. |
| | | C709 (6.2 m) | 7.559 | n.d. | n.d. | n.d. | n.d. | n.d. |
| | | C710 (6.2 m) | 17.8 | n.d. | n.d. | n.d. | n.d. | n.d. |
| 47 | shared clones | C144 (1.3 m) | 1.831 | 1.8235 | >10000 | >10000 | 1.822 | 1.872 |
| | | C050 (6.2 m) | 1.929 | 1.668 | >10000 | 1.449 | 1.471 | 1.793 |
| | | C051 (6.2 m) | 1.65 | 2.3 | 200.4 | 1.458 | 1.628 | 2.094 |
| | | C052 (6.2 m) | 1.23 | 1.3 | >10000 | 12.15 | 1.52 | 1.654 |
| | | C053 (6.2 m) | 1.5255 | 1.568 | >10000 | 2.118 | 1.653 | 1.821 |
| | | C054 (6.2 m) | 1.5785 | 1.589 | >10000 | >10000 | 1.916 | 1.857 |
| | | C164 (1.3 m) | 1.4135 | 1.548 | 76.52 | 1.354 | 1.614 | 1.42 |
| | | C143 (1.3 m) | 2.0095 | 1.8425 | 500.55 | 2.112 | 2.163 | 1.724 |
| | | C055 (6.2 m) | 1.2492 | 1.299 | 3.151 | 1.272 | 1.474 | 1.351 |
| | | C058 (1.3 m) | 2.284 | 2.62 | >10000 | 601.3 | 2.356 | 2.707 |
| | | C057 (6.2 m) | 2.31 | 2.4325 | >10000 | 9.78 | 1.718 | 1.827 |
| | | C059 (6.2 m) | 1.88 | 2.2665 | >10000 | 4.371 | 5.691 | 1.634 |
| | | C148 (1.3 m) | 616.6 | 280.5 | 7067 | >10000 | 114.6 | >10000 |
| | | C060 (6.2 m) | 43.54 | 22.02 | 4040 | 4328 | 111.7 | 773.5 |
| | | C151 (1.3 m) | 15.02 | 20.25 | 38.13 | 22.87 | 45.31 | 226.4 |
| | | C062 (6.2 m) | 4.689 | 9.391 | 127.5 | 10.84 | 17.4 | 26.93 |
| | shared singlets | C089 (1.3 m) | 4.694 | 9.324 | >10000 | 11.64 | 40.61 | 49.85 |
| | | C090 (6.2 m) | 6.216 | 11.82 | 40.01 | 18.65 | 31.23 | 100.2 |
| | | C085 (1.3 m) | 2.38 | 2.727 | 4.296 | >10000 | 3.72 | 3.925 |
| | | C086 (6.2 m) | 3.008 | 3.08 | 5.363 | 456 | 3.183 | 2.867 |
| | new clones | C518 (6.2 m) | 1.13 | n.d. | n.d. | n.d. | n.d. | n.d. |
| | | C519 (6.2 m) | 1.065 | n.d. | n.d. | n.d. | n.d. | n.d. |
| | randomly selected | C063 (6.2 m) | 414 | n.d. | n.d. | n.d. | n.d. | n.d. |
| | | C064 (6.2 m) | 362.7 | n.d. | n.d. | n.d. | n.d. | n.d. |

TABLE 5-continued

| | | | mAb EC50s | | | | | |
|---|---|---|---|---|---|---|---|---|
| | | C065 (6.2 m) | 29.13 | n.d. | n.d. | n.d. | n.d. | n.d. |
| | | C066 (6.2 m) | 4.204 | n.d. | n.d. | n.d. | n.d. | n.d. |
| | | C067 (6.2 m) | 6.976 | n.d. | n.d. | n.d. | n.d. | n.d. |
| | | C068 (6.2 m) | 5.455 | n.d. | n.d. | n.d. | n.d. | n.d. |
| | | C069 (6.2 m) | 381.4 | n.d. | n.d. | n.d. | n.d. | n.d. |
| | | C083 (1.3 m) | 25.12 | n.d. | n.d. | n.d. | n.d. | n.d. |
| | | C088 (6.2 m) | 2.44 | n.d. | n.d. | n.d. | n.d. | n.d. |
| 57 | shared clones | C032 (1.3 m) | 17.29 | 934.8 | 72.62 | 25.82 | 68.28 | 1320 |
| | | C080 (6.2 m) | 1.969 | 1.736 | 2.657 | 1.998 | 2.268 | 2.283 |
| | | C093 (1.3 m) | 1.02 | 0.8772 | 37.05 | 235.6 | 2.918 | 3.201 |
| | | C094 (6.2 m) | 1.67 | 1.557 | 244.9 | 931.6 | 2.827 | 2.458 |
| | | C091 (1.3 m) | 89.45 | 3.533 | 8.09 | 3.762 | 3.038 | 23.38 |
| | | C092 (6.2 m) | 7.066 | 2.776 | 3.135 | 3.137 | 2.405 | 3.22 |
| | new clones | C520 (6.2 m) | >10000 | n.d. | n.d. | n.d. | n.d. | n.d. |
| | | C521 (6.2 m) | 6.9 | n.d. | n.d. | n.d. | n.d. | n.d. |
| | | C522 (6.2 m) | 0.93 | n.d. | n.d. | n.d. | n.d. | n.d. |
| | randomly selected | C034 (1.3 m) | 15.67 | n.d. | n.d. | n.d. | n.d. | n.d. |
| | | C035 (1.3 m) | 15.16 | n.d. | n.d. | n.d. | n.d. | n.d. |
| | | C070 (6.2 m) | >10000 | n.d. | n.d. | n.d. | n.d. | n.d. |
| | | C073 (6.2 m) | 20.61 | n.d. | n.d. | n.d. | n.d. | n.d. |
| | | C075 (6.2 m) | >10000 | n.d. | n.d. | n.d. | n.d. | n.d. |
| | | C077 (6.2 m) | 45.95 | n.d. | n.d. | n.d. | n.d. | n.d. |
| | | C078 (6.2 m) | 3859 | n.d. | n.d. | n.d. | n.d. | n.d. |
| | | C079 (6.2 m) | >10000 | n.d. | n.d. | n.d. | n.d. | n.d. |
| 72 | shared clones | C132 (1.3 m) | 3.5625 | >10000 | 7.5395 | 2.547 | 3.811 | 2.21 |
| | | C512 (6.2 m) | 1.6785 | 2.1335 | 1.4285 | 1.625 | 1.376 | 1.595 |
| | | C128 (1.3 m) | 2.28 | 1.606 | 2.958 | 1.933 | 2.092 | 2.028 |
| | | C513 (6.2 m) | 1.31 | 0.9926 | 1.415 | 1.211 | 1.312 | 1.284 |
| | | C515 (1.3 m) | 1.73 | 1.35 | 2.486 | 3.49 | 1.436 | 1.603 |
| | | C511 (6.2 m) | 1.33 | 0.9596 | 1.243 | 1.434 | 0.9147 | 1.208 |
| | | C516 (1.3 m) | 5.72 | n.d. | n.d. | n.d. | n.d. | n.d. |
| | | C502 (6.2 m) | 6.48 | n.d. | n.d. | n.d. | n.d. | n.d. |
| | shared singlets | C517 (1.3 m) | 0.87 | 1.025 | 1.185 | 1.2 | 1.26 | 1.385 |
| | | C514 (6.2 m) | 0.82 | 0.9783 | 0.8688 | 0.9353 | 0.9793 | 1.068 |
| | | C597 (1.3 m) | 3.766 | 2.45 | 4.416 | 4.196 | 2.08 | 1.953 |
| | | C598 (6.2 m) | 3.782 | 2.573 | 3.158 | 3.019 | 2.056 | 2.084 |
| | randomly selected | C501 (6.2 m) | >10000 | n.d. | n.d. | n.d. | n.d. | n.d. |
| | | C503 (6.2 m) | 6.477 | n.d. | n.d. | n.d. | n.d. | n.d. |
| | | C504 (6.2 m) | 6.549 | n.d. | n.d. | n.d. | n.d. | n.d. |
| | | C505 (6.2 m) | 9.082 | n.d. | n.d. | n.d. | n.d. | n.d. |
| | | C506 (6.2 m) | 15.98 | n.d. | n.d. | n.d. | n.d. | n.d. |
| | | C510 (6.2 m) | 5.942 | n.d. | n.d. | n.d. | n.d. | n.d. |
| | | C507 (6.2 m) | 5.602 | n.d. | n.d. | n.d. | n.d. | n.d. |
| | | C508 (6.2 m) | >10000 | n.d. | n.d. | n.d. | n.d. | n.d. |
| | | C509 (6.2 m) | 4.439 | n.d. | n.d. | n.d. | n.d. | n.d. |
| | | C135 (1.3 m) | 3.019 | >10000 | 3.552 | 2.03 | 2.66 | >10000 |
| 96 | shared clones | C201 (1.3 m) | 1.585 | 1.388 | 2.863 | 1.247 | 1.24 | 1.615 |
| | | C539 (6.2 m) | 1.302 | 1.163 | 1.789 | 1.374 | 1.413 | 1.791 |
| | | C216 (1.3 m) | 2.892 | 0.2625 | 2.244 | 2.045 | 2.391 | 3.187 |
| | | C540 (6.2 m) | 2.904 | 1.716 | 2.319 | 1.774 | 1.783 | 2.617 |
| | | C547 (1.3 m) | 1.784 | 1.883 | 2.808 | 11.65 | 19.19 | 17.39 |
| | | C543 (6.2 m) | 1.28 | 1.411 | 1.226 | 3.842 | 4.641 | 2.778 |
| | | C209 (1.3 m) | 1.76 | 1.493 | 2.439 | 1.515 | 1.633 | 2.06 |
| | | C544 (6.2 m) | 2.343 | 2.048 | 2.728 | 2.093 | 2.152 | 2.85 |
| | | C202 (1.3 m) | 1.586 | 1.325 | 2.689 | 101.2 | 2.89 | 2.597 |
| | | C542 (6.2 m) | 1.073 | 1.082 | 0.69 | 1.797 | 1.764 | 1.553 |
| | | C213 (1.3 m) | 2.022 | 1.59 | 1.866 | 1.314 | 1.786 | 1.61 |
| | | C217 (1.3 m) | 2.281 | 1.682 | 1.943 | 1.784 | 1.814 | 1.8 |
| | | C545 (6.2 m) | 3.677 | 1.839 | 2.074 | 1.542 | 3.426 | 2.74 |
| | shared singlets | C548 (1.3 m) | 1.717 | 1.9395 | >10000 | 49.38 | 1.778 | 1.545 |
| | | C549 (6.2 m) | 1.758 | 1.914 | 1.475 | 1.478 | 2.132 | 2.612 |
| | | C552 (1.3 m) | 1.081 | 1.162 | 1.14 | 1.408 | 1.366 | 2.166 |
| | | C553 (6.2 m) | 1.194 | 1.266 | 1.129 | 1.772 | 1.729 | 2.476 |
| | | C558 (1.3 m) | 2.41 | 1.581 | 1.559 | 24.28 | 5.104 | 16.29 |
| | | C559 (6.2 m) | 2.887 | 1.961 | 2 | 44.53 | 4.09 | >10000 |
| | | C564 (1.3 m) | 14.64 | 6.592 | 9.81 | 251.1 | 233.2 | 2113 |
| | | C546 (6.2 m) | 3.57 | 2.28 | 2.438 | 10.79 | 24.5 | 25.91 |
| | | C560 (1.3 m) | 1.6 | 1.228 | 2.143 | 4.082 | 5.072 | 6.094 |
| | | C561 (6.2 m) | 1.53 | 0.8889 | 1.087 | 2.561 | 2.722 | 2.478 |
| | | C554 (1.3 m) | 8.2 | 2.357 | 7.007 | >10000 | 11.96 | 19.72 |
| | | C555 (6.2 m) | 2.88 | 1.63 | 2.315 | 3.423 | 4.284 | 4.793 |
| | | C550 (1.3 m) | 2.56 | 2.772 | 6.178 | 6.263 | 11.4 | 7.483 |
| | | C532 (6.2 m) | 1 | 1.145 | 1.356 | 2.798 | 4.438 | 3.981 |
| | | C556 (1.3 m) | 1.364 | 1.88 | 2.286 | 1.348 | 1.532 | 1.443 |
| | | C557 (6.2 m) | 2.179 | 1.254 | 2.261 | 1.238 | 1.693 | 2.013 |
| | new clones | C533 (6.2 m) | 1.61 | n.d. | n.d. | n.d. | n.d. | n.d. |
| | | C534 (6.2 m) | 4.849 | n.d. | n.d. | n.d. | n.d. | n.d. |
| | | C535 (6.2 m) | 2.46 | n.d. | n.d. | n.d. | n.d. | n.d. |

TABLE 5-continued

| mAb EC50s | | | | | | | | |
|---|---|---|---|---|---|---|---|---|
| | | C536 (6.2 m) | 1.875 | n.d. | n.d. | n.d. | n.d. | n.d. |
| | | C537 (6.2 m) | 41.85 | n.d. | n.d. | n.d. | n.d. | n.d. |
| | | C538 (6.2 m) | 3.945 | n.d. | n.d. | n.d. | n.d. | n.d. |
| | | C562 (6.2 m) | 2.554 | n.d. | n.d. | n.d. | n.d. | n.d. |
| | | C563 (6.2 m) | 1.187 | n.d. | n.d. | n.d. | n.d. | n.d. |
| | randomly selected | C523 (6.2 m) | 9.076 | n.d. | n.d. | n.d. | n.d. | n.d. |
| | | C524 (6.2 m) | 4.996 | n.d. | n.d. | n.d. | n.d. | n.d. |
| | | C525 (6.2 m) | 10.56 | n.d. | n.d. | n.d. | n.d. | n.d. |
| | | C526 (6.2 m) | 18.25 | n.d. | n.d. | n.d. | n.d. | n.d. |
| | | C527 (6.2 m) | 13.44 | n.d. | n.d. | n.d. | n.d. | n.d. |
| | | C528 (6.2 m) | 5.664 | n.d. | n.d. | n.d. | n.d. | n.d. |
| | | C529 (6.2 m) | 7.995 | n.d. | n.d. | n.d. | n.d. | n.d. |
| | | C530 (6.2 m) | 10.46 | n.d. | n.d. | n.d. | n.d. | n.d. |
| | | C531 (6.2 m) | 6.843 | n.d. | n.d. | n.d. | n.d. | n.d. |
| 107 | shared clones | C114 (1.3 m) | 4.048 | 22.16 | 1547 | 1.787 | 1.894 | 1.59 |
| | | C571 (6.2 m) | 4.625 | 2.828 | 26.56 | 1.929 | 4.104 | 4.783 |
| | | C115 (1.3 m) | 3.154 | 2.908 | >10000 | 250.6 | 2.517 | 2.092 |
| | | C572 (6.2 m) | 2.903 | 2.432 | 3974 | 297.4 | 2.016 | 1.462 |
| | | C108 (1.3 m) | 14.97 | >10000 | 52.35 | 6.82 | 28.56 | 5 |
| | | C573 (6.2 m) | 2.202 | 3555 | 5.567 | 2.272 | 1.9 | 1.605 |
| | shared singlets | C574 (1.3 m) | 8.121 | >10000 | >10000 | 2.611 | 5.394 | >10000 |
| | | C575 (6.2 m) | 6.086 | >10000 | >10000 | 2.893 | 5.501 | >10000 |
| | | C576 (1.3 m) | 5.29 | 2.792 | 7.882 | 2.682 | 3.065 | 4.368 |
| | | C577 (6.2 m) | 1.3225 | 0.698 | 1.9705 | 1.872 | 1.837 | 1.889 |
| | | C578 (1.3 m) | 1.08 | 1.271 | 136.7 | >10000 | 1.316 | 1.689 |
| | | C579 (6.2 m) | 3.48 | 2.365 | 2108 | >10000 | 3.3 | 4.2 |
| | | C581 (1.3 m) | 1.583 | 3.042 | 2.746 | 1.533 | 1.77 | 1.809 |
| | | C580 (6.2 m) | 1.815 | 1.69 | 2.504 | 1.832 | 2.206 | 1.925 |
| | | C591 (1.3 m) | 3.832 | 3.951 | >10000 | 5.374 | 5.255 | 4.304 |
| | | C592 (6.2 m) | 5.998 | 6.34 | >10000 | 5.872 | 4.48 | 5.831 |
| | | C594 (1.3 m) | 2.632 | 6.299 | 37.37 | 1.762 | 17.83 | 7.225 |
| | | C595 (6.2 m) | 2.039 | 1.668 | 4.487 | 1.034 | 9.203 | 3.194 |
| | New clones | C565 (6.2 m) | 1.27 | n.d. | n.d. | n.d. | n.d. | n.d. |
| | | C566 (6.2 m) | 5.884 | n.d. | n.d. | n.d. | n.d. | n.d. |
| | | C567 (6.2 m) | 18.9 | n.d. | n.d. | n.d. | n.d. | n.d. |
| | | C568 (6.2 m) | 5.99 | n.d. | n.d. | n.d. | n.d. | n.d. |
| | | C569 (6.2 m) | 11.05 | n.d. | n.d. | n.d. | n.d. | n.d. |
| | | C570 (6.2 m) | 0.74 | n.d. | n.d. | n.d. | n.d. | n.d. |
| | | C593 (6.2 m) | 4.359 | n.d. | n.d. | n.d. | n.d. | n.d. |
| | | C596 (6.2 m) | 21.02 | n.d. | n.d. | n.d. | n.d. | n.d. |
| | randomly selected | C582 (6.2 m) | 8.432 | n.d. | n.d. | n.d. | n.d. | n.d. |
| | | C583 (6.2 m) | 4.424 | n.d. | n.d. | n.d. | n.d. | n.d. |
| | | C584 (6.2 m) | 10.5 | n.d. | n.d. | n.d. | n.d. | n.d. |
| | | C585 (6.2 m) | 11 | n.d. | n.d. | n.d. | n.d. | n.d. |
| | | C586 (6.2 m) | 5.422 | n.d. | n.d. | n.d. | n.d. | n.d. |
| | | C587 (6.2 m) | 4.392 | n.d. | n.d. | n.d. | n.d. | n.d. |
| | | C588 (6.2 m) | 1.362 | n.d. | n.d. | n.d. | n.d. | n.d. |
| | | C589 (6.2 m) | 6.614 | n.d. | n.d. | n.d. | n.d. | n.d. |
| | | C590 (6.2 m) | 2.812 | n.d. | n.d. | n.d. | n.d. | n.d. |

| | | | Epitope $EC_{50}$ (ng/ml) | | | |
|---|---|---|---|---|---|---|
| Patient | | Antibody | A475V | S477N | V483A | V367F |
| 21 | shared clones | C005 (1.3 m) | 1.576 | 1.537 | 1.455 | 1.415 |
| | | C043 (6.2 m) | 1.365 | 1.524 | 1.349 | 1.515 |
| | | C002 (1.3 m) | 1.218 | 1.275 | 3.189 | 1.167 |
| | | C095 (6.2 m) | 1.08 | 1.152 | 0.9391 | 1.069 |
| | | C021 (1.3 m) | 6.825 | 3.965 | 4.32 | 3.45 |
| | | C097 (6.2 m) | 2.366 | 2.354 | 2.124 | 2.45 |
| | shared singlets | C048 (1.3 m) | 3.886 | 3.382 | 3.985 | 3.135 |
| | | C049 (6.2 m) | 3.316 | 2.412 | 2.834 | 3.051 |
| | | C044 (1.3 m) | 94.12 | 2.127 | 2.635 | 2.525 |
| | | C045 (6.2 m) | 4.043 | 1.606 | 1.742 | 1.774 |
| | | C098 (1.3 m) | >10000 | 6.345 | 9.394 | 5.39 |
| | | C099 (6.2 m) | 1.828 | 1.642 | 1.549 | 1.541 |
| | new clones | C047 (6.2 m) | n.d. | n.d. | n.d. | n.d. |
| | randomly selected | C046 (6.2 m) | n.d. | n.d. | n.d. | n.d. |
| | | C096 (6.2 m) | n.d. | n.d. | n.d. | n.d. |
| | | C703 (6.2 m) | n.d. | n.d. | n.d. | n.d. |
| | | C704 (6.2 m) | n.d. | n.d. | n.d. | n.d. |
| | | C706 (6.2 m) | n.d. | n.d. | n.d. | n.d. |
| | | C707 (6.2 m) | n.d. | n.d. | n.d. | n.d. |
| | | C708 (6.2 m) | n.d. | n.d. | n.d. | n.d. |
| | | C709 (6.2 m) | n.d. | n.d. | n.d. | n.d. |
| | | C710 (6.2 m) | n.d. | n.d. | n.d. | n.d. |

TABLE 5-continued

| mAb EC50s | | | | | | |
|---|---|---|---|---|---|---|
| 47 | shared clones | C144 (1.3 m) | 2.369 | 1.647 | 1.719 | 1.447 |
| | | C050 (6.2 m) | 1.676 | 1.513 | 1.877 | 1.781 |
| | | C051 (6.2 m) | 1.572 | 1.697 | 1.981 | 2.009 |
| | | C052 (6.2 m) | 1.41 | 1.523 | 1.421 | 1.528 |
| | | C053 (6.2 m) | 1.612 | 1.562 | 1.831 | 1.625 |
| | | C054 (6.2 m) | 1.82 | 1.597 | 1.73 | 1.54 |
| | | C164 (1.3 m) | 2.185 | 1.377 | 1.503 | 1.302 |
| | | C143 (1.3 m) | 14.43 | 1.563 | 1.129 | 1.209 |
| | | C055 (6.2 m) | 1.226 | 1.161 | 1.54 | 1.28 |
| | | C058 (1.3 m) | 2.274 | 1.934 | 2.853 | 2.314 |
| | | C057 (6.2 m) | 1.831 | 1.4 | 1.998 | 1.956 |
| | | C059 (6.2 m) | 1.693 | 1.515 | 2.043 | 1.931 |
| | | C148 (1.3 m) | >10000 | 30.99 | >10000 | >10000 |
| | | C060 (6.2 m) | >10000 | 38.21 | 1413 | 7849 |
| | | C151 (1.3 m) | 67.25 | 20.35 | 19.02 | 13.45 |
| | | C062 (6.2 m) | 64.52 | 5.704 | 5.549 | 3.896 |
| | shared singlets | C089 (1.3 m) | 58.56 | 10 | 10.74 | 125.3 |
| | | C090 (6.2 m) | 42.96 | 10.51 | 9.695 | 84.08 |
| | | C085 (1.3 m) | 2.551 | 2.188 | 2.184 | 1.971 |
| | | C086 (6.2 m) | 2.675 | 2.605 | 2.848 | 2.389 |
| | new clones | C518 (6.2 m) | n.d. | n.d. | n.d. | n.d. |
| | | C519 (6.2 m) | n.d. | n.d. | n.d. | n.d. |
| | randomly selected | C063 (6.2 m) | n.d. | n.d. | n.d. | n.d. |
| | | C064 (6.2 m) | n.d. | n.d. | n.d. | n.d. |
| | | C065 (6.2 m) | n.d. | n.d. | n.d. | n.d. |
| | | C066 (6.2 m) | n.d. | n.d. | n.d. | n.d. |
| | | C067 (6.2 m) | n.d. | n.d. | n.d. | n.d. |
| | | C068 (6.2 m) | n.d. | n.d. | n.d. | n.d. |
| | | C069 (6.2 m) | n.d. | n.d. | n.d. | n.d. |
| | | C083 (1.3 m) | n.d. | n.d. | n.d. | n.d. |
| | | C088 (6.2 m) | n.d. | n.d. | n.d. | n.d. |
| 57 | shared clones | C032 (1.3 m) | 38.6 | 19.24 | 15.38 | 7.508 |
| | | C080 (6.2 m) | 2.603 | 2.273 | 2.215 | 2.439 |
| | | C093 (1.3 m) | 2.351 | 2.418 | 3.192 | 2.505 |
| | | C094 (6.2 m) | 1.971 | 2.084 | 2.291 | 2.441 |
| | | C091 (1.3 m) | 4.281 | 3.467 | 117.9 | 25.24 |
| | | C092 (6.2 m) | 2.923 | 2.7 | 3.088 | 3.784 |
| | new clones | C520 (6.2 m) | n.d. | n.d. | n.d. | n.d. |
| | | C521 (6.2 m) | n.d. | n.d. | n.d. | n.d. |
| | | C522 (6.2 m) | n.d. | n.d. | n.d. | n.d. |
| | randomly selected | C034 (1.3 m) | n.d. | n.d. | n.d. | n.d. |
| | | C035 (1.3 m) | n.d. | n.d. | n.d. | n.d. |
| | | C070 (6.2 m) | n.d. | n.d. | n.d. | n.d. |
| | | C073 (6.2 m) | n.d. | n.d. | n.d. | n.d. |
| | | C075 (6.2 m) | n.d. | n.d. | n.d. | n.d. |
| | | C077 (6.2 m) | n.d. | n.d. | n.d. | n.d. |
| | | C078 (6.2 m) | n.d. | n.d. | n.d. | n.d. |
| | | C079 (6.2 m) | n.d. | n.d. | n.d. | n.d. |
| 72 | shared clones | C132 (1.3 m) | 3.736 | 2.228 | 2.233 | 2.127 |
| | | C512 (6.2 m) | 1.682 | 1.455 | 1.794 | 1.873 |
| | | C128 (1.3 m) | 4.997 | 1.659 | 1.549 | 1.746 |
| | | C513 (6.2 m) | 1.403 | 1.118 | 1.038 | 1.112 |
| | | C515 (1.3 m) | 10.72 | 1.28 | 1.428 | 1.548 |
| | | C511 (6.2 m) | 1.268 | 0.963 | 1.125 | 1.123 |
| | | C516 (1.3 m) | n.d. | n.d. | n.d. | n.d. |
| | | C502 (6.2 m) | n.d. | n.d. | n.d. | n.d. |
| | shared singlets | C517 (1.3 m) | 1.248 | 1.239 | 1.292 | 1.441 |
| | | C514 (6.2 m) | 0.9336 | 0.9761 | 1.017 | 1.213 |
| | | C597 (1.3 m) | 2.573 | 2.007 | 2.171 | 2.189 |
| | | C598 (6.2 m) | 2.445 | 2.161 | 2.266 | 2.211 |
| | randomly selected | C501 (6.2 m) | n.d. | n.d. | n.d. | n.d. |
| | | C503 (6.2 m) | n.d. | n.d. | n.d. | n.d. |
| | | C504 (6.2 m) | n.d. | n.d. | n.d. | n.d. |
| | | C505 (6.2 m) | n.d. | n.d. | n.d. | n.d. |
| | | C506 (6.2 m) | n.d. | n.d. | n.d. | n.d. |
| | | C510 (6.2 m) | n.d. | n.d. | n.d. | n.d. |
| | | C507 (6.2 m) | n.d. | n.d. | n.d. | n.d. |
| | | C508 (6.2 m) | n.d. | n.d. | n.d. | n.d. |
| | | C509 (6.2 m) | n.d. | n.d. | n.d. | n.d. |
| | | C135 (1.3 m) | 2.06 | 1.79 | 2.108 | 2.081 |
| 96 | shared clones | C201 (1.3 m) | 1.308 | 1.245 | 1.339 | 1.399 |
| | | C539 (6.2 m) | 1.49 | 1.432 | 1.603 | 1.917 |
| | | C216 (1.3 m) | 2.65 | 2.591 | 2.681 | 2.458 |
| | | C540 (6.2 m) | 1.962 | 1.881 | 2.429 | 2.392 |
| | | C547 (1.3 m) | 4.993 | 3.084 | 4.115 | 4.02 |
| | | C543 (6.2 m) | 2.229 | 1.663 | 2.278 | 1.851 |
| | | C209 (1.3 m) | 1.712 | 1.685 | 1.887 | 1.842 |
| | | C544 (6.2 m) | 2.211 | 2 | 2.332 | 2.372 |

TABLE 5-continued

| mAb EC50s | | | | | | |
|---|---|---|---|---|---|---|
| | | C202 (1.3 m) | 5589 | 2.069 | 1.733 | 1.714 |
| | | C542 (6.2 m) | 2.326 | 1.473 | 1.422 | 1.384 |
| | | C213 (1.3 m) | 1.538 | 1.415 | 1.168 | 1.376 |
| | | C217 (1.3 m) | 1.566 | 1.468 | 1.247 | 1.476 |
| | | C545 (6.2 m) | 2.624 | 1.377 | 1.192 | 1.655 |
| | shared singlets | C548 (1.3 m) | 1.68 | 1.486 | 1.349 | 1.452 |
| | | C549 (6.2 m) | 2.395 | 2.285 | 2.341 | 2.64 |
| | | C552 (1.3 m) | 1.771 | 1.476 | 1.908 | 1.989 |
| | | C553 (6.2 m) | 2.109 | 1.9 | 2.284 | 2.384 |
| | | C558 (1.3 m) | 1.125 | 1.033 | >10000 | 1.06 |
| | | C559 (6.2 m) | 3.469 | 1.365 | >10000 | 2.897 |
| | | C564 (1.3 m) | 396.9 | 44.26 | 38.27 | 39.96 |
| | | C546 (6.2 m) | 38.13 | 10.85 | 12.37 | 8.973 |
| | | C560 (1.3 m) | 7.018 | 4.199 | 3.672 | 4.279 |
| | | C561 (6.2 m) | 2.864 | 2.87 | 3.174 | 3.192 |
| | | C554 (1.3 m) | 32.37 | 10.86 | 5.703 | 7.508 |
| | | C555 (6.2 m) | 6.129 | 4.337 | 4.18 | 5.223 |
| | | C550 (1.3 m) | 20.44 | 7.269 | 6.825 | 48.37 |
| | | C532 (6.2 m) | 18.92 | 3.003 | 4.355 | 6.282 |
| | | C556 (1.3 m) | 1.242 | 1.124 | 1.101 | 0.8145 |
| | | C557 (6.2 m) | 1.341 | 1.178 | 0.9521 | 0.9152 |
| | new clones | C533 (6.2 m) | n.d. | n.d. | n.d. | n.d. |
| | | C534 (6.2 m) | n.d. | n.d. | n.d. | n.d. |
| | | C535 (6.2 m) | n.d. | n.d. | n.d. | n.d. |
| | | C536 (6.2 m) | n.d. | n.d. | n.d. | n.d. |
| | | C537 (6.2 m) | n.d. | n.d. | n.d. | n.d. |
| | | C538 (6.2 m) | n.d. | n.d. | n.d. | n.d. |
| | | C562 (6.2 m) | n.d. | n.d. | n.d. | n.d. |
| | | C563 (6.2 m) | n.d. | n.d. | n.d. | n.d. |
| | randomly selected | C523 (6.2 m) | n.d. | n.d. | n.d. | n.d. |
| | | C524 (6.2 m) | n.d. | n.d. | n.d. | n.d. |
| | | C525 (6.2 m) | n.d. | n.d. | n.d. | n.d. |
| | | C526 (6.2 m) | n.d. | n.d. | n.d. | n.d. |
| | | C527 (6.2 m) | n.d. | n.d. | n.d. | n.d. |
| | | C528 (6.2 m) | n.d. | n.d. | n.d. | n.d. |
| | | C529 (6.2 m) | n.d. | n.d. | n.d. | n.d. |
| | | C530 (6.2 m) | n.d. | n.d. | n.d. | n.d. |
| | | C531 (6.2 m) | n.d. | n.d. | n.d. | n.d. |
| 107 | shared clones | C114 (1.3 m) | 827.6 | 1.426 | 1.405 | 2.932 |
| | | C571 (6.2 m) | >10000 | 3.791 | 3.51 | 3.281 |
| | | C115 (1.3 m) | 2.879 | 1.901 | 3.938 | 2.347 |
| | | C572 (6.2 m) | 2.2 | 1.485 | 3.186 | 1.722 |
| | | C108 (1.3 m) | 8.471 | 3.691 | 507.3 | 20.64 |
| | | C573 (6.2 m) | 2.086 | 1.358 | 1.398 | 1.544 |
| | shared singlets | C574 (1.3 m) | 4.677 | 2.626 | 3.015 | 2.707 |
| | | C575 (6.2 m) | 4.404 | 2.392 | 2.661 | 2.311 |
| | | C576 (1.3 m) | 2.628 | 2.611 | 2.544 | 2.267 |
| | | C577 (6.2 m) | 1.661 | 1.704 | 1.793 | 1.829 |
| | | C578 (1.3 m) | 1.385 | 1.561 | 1.517 | 1.644 |
| | | C579 (6.2 m) | 3.37 | 2.93 | 3.79 | 3.199 |
| | | C581 (1.3 m) | 1.737 | 1.837 | 1.586 | 4.255 |
| | | C580 (6.2 m) | 1.988 | 2.03 | 1.747 | 2.112 |
| | | C591 (1.3 m) | 4.205 | 3.149 | 3.663 | 3.259 |
| | | C592 (6.2 m) | 5.035 | 5.101 | 5.374 | 5.581 |
| | | C594 (1.3 m) | 2.045 | 1.78 | 2.009 | 1.839 |
| | | C595 (6.2 m) | 2.298 | 1.948 | 2.082 | 1.854 |
| | New clones | C565 (6.2 m) | n.d. | n.d. | n.d. | n.d. |
| | | C566 (6.2 m) | n.d. | n.d. | n.d. | n.d. |
| | | C567 (6.2 m) | n.d. | n.d. | n.d. | n.d. |
| | | C568 (6.2 m) | n.d. | n.d. | n.d. | n.d. |
| | | C569 (6.2 m) | n.d. | n.d. | n.d. | n.d. |
| | | C570 (6.2 m) | n.d. | n.d. | n.d. | n.d. |
| | | C593 (6.2 m) | n.d. | n.d. | n.d. | n.d. |
| | | C596 (6.2 m) | n.d. | n.d. | n.d. | n.d. |
| | randomly selected | C582 (6.2 m) | n.d. | n.d. | n.d. | n.d. |
| | | C583 (6.2 m) | n.d. | n.d. | n.d. | n.d. |
| | | C584 (6.2 m) | n.d. | n.d. | n.d. | n.d. |
| | | C585 (6.2 m) | n.d. | n.d. | n.d. | n.d. |
| | | C586 (6.2 m) | n.d. | n.d. | n.d. | n.d. |
| | | C587 (6.2 m) | n.d. | n.d. | n.d. | n.d. |
| | | C588 (6.2 m) | n.d. | n.d. | n.d. | n.d. |
| | | C589 (6.2 m) | n.d. | n.d. | n.d. | n.d. |
| | | C590 (6.2 m) | n.d. | n.d. | n.d. | n.d. |

Next, all 122 antibodies from the 6.2 month time point were tested for activity in a pseudotyped SARS-CoV-2 neutralization assay (FIG. 4*a* and Table 6). Consistent with RBD binding assays, the mean neutralization $IC_{50}$ values were not significantly different at the two time points when all antibodies were compared (FIG. 4*a*). However, comparison of the antibodies that were present at both time points revealed a significant improvement of the $IC_{50}$ values at 6.2 months (p=0.0003, FIG. 4*b* and FIG. 12*a*).

TABLE 6

Inhibitory concentrations of the monoclonal antibodies

| | | mAb (1.3 months) | | | mAb (6.2 months) | | |
|---|---|---|---|---|---|---|---|
| patient | | ID | IC50 [ng/ml] | IC90 [ng/ml] | ID | IC50 [ng/ml] | IC90 [ng/ml] |
| 21 | shared | C005 | 60.49* | 205.20* | C043 | 10.56 | 74.43 |
| | clones | C002 | 8.88* | 37.61* | C095 | 11.28 | 52.56 |
| | | C021 | >10000* | | C097 | 9.60 | 31.11 |
| | shared | C044 | >10000 | | C045 | >10000 | |
| | singlets | C048 | 62.20 | 522.84 | C049 | 18.12 | 129.11 |
| | | C098 | 478.60 | 4246.68 | C099 | 27.23 | 86.08 |
| | new | | | | C047 | >10000 | |
| | clones | | | | C710 | >10000 | |
| | randomly | | | | C046 | 8.69 | 52.59 |
| | selected | | | | C096 | 80.20 | 349.01 |
| | | | | | C706 | 2030.41 | >10000 |
| | | | | | C707 | >10000 | |
| | | | | | C709 | 406.54 | >10000 |
| | | | | | C708 | 488.95 | 8858.44 |
| | | | | | C703 | 681.46 | >10000 |
| | | | | | C704 | >10000 | |
| 47 | shared | C144 | 2.86 | 40.53 | C050 | 12.92 | 28.41 |
| | clones | | | | C051 | 12.51 | 91.69 |
| | | | | | C052 | 4.89 | 27.79 |
| | | | | | C053 | 8.23 | 39.80 |
| | | | | | C054 | 4.84 | 15.45 |
| | | C164 | 59.32 | 811.44 | C055 | 6.40 | 36.83 |
| | | C143 | 336.47 | 3002.09 | | | |
| | | C058 | 5.28 | 31.55 | C057 | 2.78 | 33.59 |
| | | | | | C059 | 8.35 | 24.49 |
| | | C148 | >10000 | | C060 | >10000 | |
| | | C151 | 1410.56 | >10000 | C062 | 703.61 | >10000 |
| | shared | C085 | 17.18 | 76.89 | C086 | 7.02 | 40.88 |
| | singlets | C089 | >10000 | | C090 | >10000 | |
| | new | | | | C518 | 31.03 | 78.53 |
| | clones | | | | C519 | 23.81 | 192.33 |
| | randomly | | | | C063 | >10000 | |
| | selected | | | | C064 | 3053.48 | >10000 |
| | | | | | C065 | 2746.14 | >10000 |
| | | | | | C066 | 22.80 | 136.01 |
| | | | | | C067 | 87.33 | 350.23 |
| | | | | | C068 | 54.70 | 114.53 |
| | | | | | C069 | 10.04 | 99.15 |
| | | | | | C088 | 14.54 | 47.15 |
| 57 | shared | C032 | 75.71 | 1402.00 | C080 | 44.28 | 1888.45 |
| | clones | | | | | | |
| | shared | C091 | 56.67 | 630.92 | C092 | 227.25 | >10000 |
| | singlets | C093 | 22.80 | 81.34 | C094 | 470.54 | 1472.13 |
| | new | | | | C520 | >10000 | |
| | clones | | | | C521 | 11.30 | 61.22 |
| | | | | | C522 | 20.64 | 73.97 |
| | randomly | | | | C070 | >10000 | |
| | selected | | | | C073 | >10000 | |
| | | | | | C075 | >10000 | |
| | | | | | C077 | >10000 | |
| | | | | | C078 | >10000 | |
| | | | | | C079 | >10000 | |
| 72 | shared | C132 | 1024.35 | >10000 | C512 | 52.23 | 274.99 |
| | clones | C128 | 70.06 | 274.60 | C513 | 12.86 | 88.44 |
| | | C515 | 11.04 | 51.00 | C511 | 28.83 | 89.14 |
| | | C516 | 8.85 | 35.24 | C502 | 12.49 | 38.46 |
| | shared | C517 | 11.31 | 49.51 | C514 | 22.28 | 86.32 |
| | singlets | C597 | 5.09 | 20.05 | C598 | 7.12 | 31.29 |
| | randomly | | | | C501 | >10000 | |
| | selected | | | | C503 | 21.57 | 81.32 |
| | | | | | C504 | >10000 | |

TABLE 6-continued

Inhibitory concentrations of the monoclonal antibodies

| patient | | mAb (1.3 months) ID | IC50 [ng/ml] | IC90 [ng/ml] | mAb (6.2 months) ID | IC50 [ng/ml] | IC90 [ng/ml] |
|---|---|---|---|---|---|---|---|
| | | | | | C505 | 234.42 | >10000 |
| | | | | | C506 | >10000 | |
| | | | | | C510 | >10000 | |
| | | | | | C507 | 1102.33 | >10000 |
| | | | | | C508 | >10000 | |
| | | | | | C509 | 14.21 | 112.09 |
| 96 | shared clones | C201 | 3171.04 | >10000 | C539 | 657.71 | >10000 |
| | | C216 | >10000 | | C540 | 7379.68 | >10000 |
| | | C202 | 323.96 | 3694.13 | C542 | 16.46 | 97.25 |
| | | C547 | 5301.94 | >10000 | C543 | 1389.22 | >10000 |
| | | C209 | 2499.24 | >10000 | C544 | 2413.78 | >10000 |
| | | C213 | 2128.97 | >10000 | C545 | 2711.36 | >10000 |
| | | C217 | 8055.33 | >10000 | | | |
| | shared singlets | C564 | >10000 | | C546 | 12640.78 | >10000 |
| | | C548 | 30.51 | 207.19 | C549 | 14.07 | 32.09 |
| | | C552 | 3095.35 | >10000 | C553 | 687.37 | >10000 |
| | | C554 | >10000 | | C555 | 276.16 | >10000 |
| | | C55O | >10000 | | C532 | 116.15 | 1779.53 |
| | | C556 | 47.18 | 738.16 | C557 | 21.52 | 2070.32 |
| | | C558 | >10000 | | C559 | 613.04 | >10000 |
| | | C560 | 145.86 | 1947.93 | C561 | 47.02 | 197.28 |
| | new clones | | | | C534 | >10000 | |
| | | | | | C536 | 91.11 | 837.79 |
| | | | | | C537 | >10000 | |
| | | | | | C538 | >10000 | |
| | | | | | C562 | 2552.29 | >10000 |
| | | | | | C563 | 4.51 | 22.94 |
| | | | | | C533 | 14.15 | 98.87 |
| | | | | | C535 | 372.46 | >10000 |
| | randomly selected | | | | C523 | 973.58 | >10000 |
| | | | | | C524 | 8.01 | 38.55 |
| | | | | | C525 | 317.73 | 3940.15 |
| | | | | | C526 | 412.25 | >10000 |
| | | | | | C527 | 917.08 | >10000 |
| | | | | | C528 | 4005.30 | >10000 |
| | | | | | C529 | 577.95 | 5512.55 |
| | | | | | C530 | 1068.11 | >10000 |
| | | | | | C531 | 55.18 | 719.62 |
| 107 | shared clones | C114 | >10000 | | C571 | 326.24 | 2134.35 |
| | | C115 | 252.22 | 3497.40 | C572 | 72.63 | 1800.09 |
| | | C108 | 480.69* | >10000* | C573 | 13.41 | 117.64 |
| | shared singlets | C574 | >10000 | | C575 | 5394.51 | >10000 |
| | | C576 | 16.19 | 312.74 | C577 | 419.38 | >10000 |
| | | C578 | 13.27 | 150.36 | C579 | 154.75 | 1054.97 |
| | | C581 | 31.57 | 351.60 | C580 | 116.79 | 575.02 |
| | | C591 | 245.65 | 2213.79 | C592 | 18.96 | 160.71 |
| | | C594 | 158.54 | 855.34 | C595 | 53.21 | 636.88 |
| | New clones | | | | C565 | 25.58 | 77.59 |
| | | | | | C566 | 129.68 | 1776.43 |
| | | | | | C567 | >10000 | |
| | | | | | C568 | >10000 | |
| | | | | | C569 | 2427.93 | >10000 |
| | | | | | C570 | 207.05 | >10000 |
| | | | | | C593 | 10.24 | 45.28 |
| | | | | | C596 | 965.51 | >10000 |
| | randomly selected | | | | C582 | 161.62 | 2079.03 |
| | | | | | C583 | 37.71 | 103.79 |
| | | | | | C584 | 3453.82 | >10000 |
| | | | | | C585 | 222.00 | 1198.28 |
| | | | | | C586 | 45.20 | 126.36 |
| | | | | | C587 | 6.17 | 31.00 |
| | | | | | C588 | 12.00 | 122.24 |
| | | | | | C589 | 227.05 | 2760.53 |
| | | | | | C590 | 96.65 | 425.47 |

*Robbiani et al. 2020

To determine whether the antibodies exhibiting altered RBD binding also show increased neutralizing breadth, 5 representative antibody pairs recovered at the two time points were tested against HIV-1 viruses pseudotyped with E484G, Q493R, and R346S mutant spike proteins (FIG. 4*c*, Table 6). Notably, the Q493R and E484G pseudotyped viruses were resistant to neutralization by C144; in contrast, its clonal derivative C051 neutralized both variants with $IC_{50}$ values of 4.7 and 3.1 ng/ml respectively (FIGS. 4*c-d*). Similarly, R346S pseudotyped viruses were resistant to C032, but a clonal derivative C080 neutralized this variant with an $IC_{50}$ of 5.3 ng/ml (FIG. 4*c* and FIGS. 12*b-f*). Consistent with the observed changes in binding and neutralizing activity, several late-appearing antibodies (e.g., C051) had acquired mutations directly in or adjacent to the RBD-binding paratope (FIG. 4*e* and FIG. 13). It was concluded that memory B cells that evolved during the observation period express antibodies with increased neutralizing potency and breadth.

Antibody evolution occurs by somatic mutation and selection in germinal centers wherein antigen can be retained in the form of immune complexes on the surface of follicular dendritic cells for prolonged periods of time. Persistent viral replication in tissues represents another potential source of antigen. SARS-CoV-2 replicates in ACE2-expressing cells in the lungs, nasopharynx, and small intestine, and viral RNA has been detected in stool samples even after the virus is cleared from the nasopharynx. To determine whether there might be antigen persistence in the intestine after resolution of clinical illness, we obtained biopsies from the upper and lower gastrointestinal (GI) tract of 14 individuals, an average of 4 months (range 2.8-5.5 months) after initial SARS-CoV-2 diagnosis (Table 7). Nasopharyngeal swab PCR assays were negative in all 14 individuals at the time of biopsy. However, biopsy samples from 3 of the 14 participants produced PCR amplicons that were sequence-verified as SARS-CoV-2. Immunostaining was performed to determine whether viral protein was also detectable in upper and lower GI tract, with de-identified biopsies from individuals pre-dating the pandemic (n=10) serving as controls. ACE2 was expressed on the intestinal brush border of SARS-CoV-2 recovered participants (FIGS. 5*a* and *c*). SARS-CoV-2 N protein was detected in the small intestinal enterocytes, from the duodenum and terminal ileum in 5 of 14 individuals but not in any control samples (FIGS. 5*b* and 5*d* and FIGS. 14-16). When detected, immunostaining was sporadic, patchy, exclusive to the intestinal epithelium and not associated with inflammatory infiltrates.

TABLE 7A

| Sinai cohort characteristics | | | | | | |
|---|---|---|---|---|---|---|
| | Baseline patient characteristics | | | | | |
| Patient ID | Cases/ controls | Sex | Age (years) | Pertinent medical history/comorbidities | Indication for GI procedure | Date of GI procedure |
| CGI088 | case | M | | seasonal allergies, asthma | GERD | June-20 |
| CGI089 | case | M | | MM, HTN | IDA | July-20 |
| CGI090 | case | M | | gout, HTN, prostate cancer | CRC screening, GERD | July-20 |
| CGI091 | case | F | | asthma | bowel changes | July-20 |
| CGI092 | case | M | | HTN, HLD | CRC screening, GERD | July-20 |
| CGI093 | case | F | | fibromyalgia, PUD, IDA, psoriasis | PUD | July-20 |
| CGI094 | case | M | | IBD (Crohn) | IBD | August-20 |
| CGI095 OSH? | case | F | | allergic rhinitis, GERD | IBS | August-20 |
| CGI096 | case | M | | prostate cancer, ESRD, DM, HTN | Rectal bleeding | August-20 |
| CGI097 | case | M | | IBD (Crohn) | IBD | August-20 |
| CGI098 | case | F | | asthma, HTN, HCV | CRC screening | September-20 |
| CGI099 | case | M | | CRC, IDA, CAD | IDA | September-20 |
| CGI100 | case | M | | DM1, CD | CD | September-20 |
| CGI106 | | | | | | |
| ctrl 1 | control | M | 55 | GERD, EE | epigastric pain | June-19 |
| ctrl 2 | control | F | 66 | HLD, MVP | abdominal pain | December-19 |
| ctrl 3 | control | F | 82 | DM2, OA, HTN, HLD, asthma, COPD, CAD | dysphagia | July-19 |
| ctrl 4 | control | F | 79 | anemia, renal angiomyolipoma, breast cancer, DM2, HTN | abdominal pain | September-18 |
| ctrl 5 | control | F | 79 | Afib, CHF, anemia, HTN, MR | weight loss | May-19 |
| ctrl 6 | control | M | 33 | DM2, obesity, HTN, heart murmur | IDA | October-19 |
| ctrl 7 | control | M | 56 | GERD, HTN, DM2, migraine, OSA, IBS, diverticulosis | abdominal pain | April-19 |
| ctrl 8 | control | M | 42 | none | rectal bleeding | September-19 |
| ctrl 9 | control | F | 51 | ulnar neuropathy, biceps tendonitis | CRC screening | April-19 |
| ctrl 10 | control | F | 23 | none | abdominal pain | July-19 |

GERD (gastroesophageal reflux disease), CRC (colorectal cancer), IDA (iron deficiency anemia), PUD (peptic ulcer disease), IBD (inflammatory bowel disease), HLD (hyperlipidemia), MV (mitral valve prolapse), MR (mitral regurgitation), DM (diabetes melitus type 2) OA (osteoarthritis), HTN (arterial hypertension), COPD (chronic obstructive pulmonary disease), CAD (coronary artery disease), Afib (atrial fibrilation), CHF (congestive heart failure), OSA (obstructive sleep apnea), IBS (irritable bowel syN/Arome), CD (celiac disease), MM (multiple myeloma), ESRD (eN/A stage renal disease), HCV (hepatitis C), EE (eosinophilic esophagitis), MDD (major depressive disorder)

TABLE 7B

Sinai cohort characteristics

| Patient ID | Detection of SARS-CoV-2 nucleocapsid (N) antigen by immunofluorescence (IF) Duodenum | Ileum | Detection of Corona virion-like particles by electron microscopy (EM) | Detection of SARS-CoV-2 by PCR from intestinal biopsy samples Genomic SARS2 | Subgenomic SARS2 | COVID-19 history Positive nasopharyngeal SARS-CoV-2 PCR | Positive SARS-CoV-2 serology | Symptom onset to GI biopsy (days) | Positive nasopharyngeal PCR to GI biopsy (days) | Nasopharyngeal PCR at the time of biopsy | Hospitalized | COVID-19 associated GI symptoms |
|---|---|---|---|---|---|---|---|---|---|---|---|---|
| CGI088 | + | + | + | – | – | March-20 | May-20 | 92 | 84 | Negative | No | No |
| CGI089 | + | + | N/A | – | – | March-20 | July-20 | N/A | 106 | Negative | No | No |
| CGI090 | – | – | N/A | – | – | March-20 | N/A | 119 | 112 | Neg? | | No |
| CGI091 | – | – | N/A | – | – | N/A | May-20 | N/A | N/A | Neg? | | No acute Sx, but ED visit in May 2020 for RLQ pain |
| CGI092 | + | + | N/A | Duodenum | – | April-20 | August-20 | N/A | 105 | Negative | No | watery diarrhea |
| CGI093 | – | N/A | N/A | – | – | N/A | May-20 | 121 | N/A | Neg? | | diarrhea nausea, abdominal pain |
| CGI094 | – | – | N/A | Terminal ileum | – | April-20 | N/A | N/A | 113 | Negative | No | No |
| CGI095 OSH? | – | – | N/A | – | – | April-20 | N/A | N/A | 130 | Neg? | | No? |
| CGI096 | N/A | – | N/A | – | – | April-20 | N/A | N/A | 148 | Negative | Yes | No |
| CGI097 | N/A | – | N/A | – | – | March-20 | June-20 | N/A | 99 | Neg? | | No |
| CGI098 | – | – | N/A | – | – | March-20 | N/A | N/A | 166 | Neg? | | No? |
| CGI099 | – | – | N/A | Duodenum | Duodenum | N/A | May-20 | 173 | N/A | Negative | No | Watery diarrhea |
| CGI100 | + | N/A | N/A | – | – | N/A | 5/2020 | N/A | N/A | Neg? | | |
| CGI106 | + | N/A | | | | | | | | | | |
| ctrl 1 | – | N/A | N/A | | | N/A | N/A | N/A | N/A | N/A | N/A | N/A |
| ctrl 2 | – | – | N/A | | | N/A | N/A | N/A | N/A | N/A | N/A | N/A |
| ctrl 3 | – | N/A | N/A | | | N/A | N/A | N/A | N/A | N/A | N/A | N/A |
| ctrl 4 | – | N/A | N/A | | | N/A | N/A | N/A | N/A | N/A | N/A | N/A |
| ctrl 5 | – | N/A | N/A | | | N/A | N/A | N/A | N/A | N/A | N/A | N/A |
| ctrl 6 | N/A | – | N/A | | | N/A | N/A | N/A | N/A | N/A | N/A | N/A |
| ctrl 7 | N/A | – | N/A | | | N/A | N/A | N/A | N/A | N/A | N/A | N/A |
| ctrl 8 | N/A | – | N/A | | | N/A | N/A | N/A | N/A | N/A | N/A | N/A |
| ctrl 9 | N/A | – | N/A | | | N/A | N/A | N/A | N/A | N/A | N/A | N/A |
| ctrl 10 | N/A | – | N/A | | | N/A | N/A | N/A | N/A | N/A | N/A | N/A |

Detection of SARS-CoV-2 RNA and N protein could represent defective viral particles and/or infected cell debris. We used electron tomography to examine a tissue sample from one of the individuals who was positive by immunoflourescence (FIGS. 5*e-j*). Particles with typical SARS-CoV-2 morphologies were found within intracellular membrane-enclosed vesicles consistent with coronavirus exit compartments in terminal ileum apical epithelial cells (FIGS. 5*e-h*), suggesting the presence of intact virions. Particles were also found in vesicles in apical epithelial cells of the duodenum, although there were fewer and less densely-populated vesicles observed (FIGS. 5*i-j*).

Neutralizing antibodies to SARS-CoV-2 develop in most individuals after infection but decay with time. These antibodies are effective in prevention and therapy in animal models and are likely to play a role in protection from re-infection in humans. Although there is a significant drop in plasma neutralizing activity between 1.3 and 6.2 months, antibody titers remain measurable in most individuals.

Neutralizing monoclonal antibodies obtained from individuals during the early convalescence period showed remarkably low levels of somatic mutations that some investigators attributed to defects in germinal center formation. The data indicates that the anti-SARS-CoV-2 memory B cell response evolves during the first 6 months after infection, with accumulation of Ig somatic mutations, and production of antibodies with increased neutralizing breadth and potency. Persistent antibody evolution occurs in germinal centers and requires that B cells are exposed to antigen trapped in the form of immune complexes on follicular dendritic cells. This form of antigen can be long-lived because follicular dendritic cells do not internalize immune complexes. Moreover, even small amounts of persistent viral replication could contribute antigen to fuel antibody evolution. The observation that SARS-CoV-2 persists in the small intestinal epithelium even 3 months after infection, at a time when it is not detectable in the nasopharynx by standard quantitative PCR, is consistent with the relative persistence of anti-RBD IgA antibodies and continued antibody evolution.

Memory responses are responsible for protection from re-infection and are essential for effective vaccination. The observation that memory B cell responses do not decay after 6.2 months, but instead continue to evolve, is strongly suggestive that individuals who are infected with SARS-CoV-2 could mount a rapid and effective response to the virus upon re-exposure.

Methods

Study Participants.

Previously enrolled study participants (Robbiani, D. F. et al. Nature 584, 437-442) were asked to return for a 6-month follow-up visit at the Rockefeller University Hospital in New York from August 31 through Oct. 16, 2020. Eligible participants were adults aged 18-76 years and were either diagnosed with SARS-CoV-2 infection by RT-PCR (cases), or were close contacts (e.g., household, co-workers, members of same religious community) with someone who had been diagnosed with SARS-CoV-2 infection by RT-PCR (contacts). Close contacts without seroconversion against SARS-CoV-2 as assessed by serological assays (described below) were not included in the subsequent analysis. Most study participants were residents of the Greater New York City tri-state region and were asked to return approximately 6 months after the time of onset of COVID-19 symptoms. Participants presented to the Rockefeller University Hospital for blood sample collection and were asked to recall the symptoms and severity of clinical presentation during the acute (first 6 weeks) and the convalescent (7 weeks until the second study visit) phase of COVID-19, respectively. The severity of acute infection was assessed by the WHO Ordinal Clinical Progression/Improvement Scale (https://www.who.int/publications/i/item/covid-19-therapeutic-trial-synopsis). Shortness of breath was assessed through the modified Medical Research Council (mMRC) dyspnea scale. Participants who presented with persistent symptoms attributable to COVID-19 were identified on the basis of chronic shortness of breath or fatigue, deficit in athletic ability and/or three or more additional long-term symptoms such as persistent unexplained fevers, chest pain, new-onset cardiac sequalae, arthralgias, impairment of concentration/mental acuity, impairment of sense of smell/taste, neuropathy or cutaneous findings. All participants at Rockefeller University provided written informed consent before participation in the study, and the study was conducted in accordance with Good Clinical Practice.

Gastrointestinal Biopsy Cohort.

To determine if SARS-CoV-2 can persist in the gastrointestinal tract, we recruited a cohort of 14 individuals with prior diagnosis of and recovery from COVID-19 illness. Eligible participants included adults, 18-76 years of age who were previously diagnosed with SARS-CoV-2 by RT PCR and presented to the gastroenterology clinics of Mount Sinai Hospital. Endoscopic procedures were performed for clinically indicated conditions as detailed in Table 7. All participants were negative for SARS-CoV-2 by nasal swab PCR and asymptomatic at the time of the endoscopic procedures. Informed consent was obtained from all participants. The biopsy-related studies were approved by the Mount Sinai Ethics Committee/IRB (IRB 16-0583, The impact of viral infections and their treatment on gastrointestinal immune cells).

SARS-CoV-2 Saliva PCR Test

Saliva was collected into guanidine thiocyanate buffer as described (Chomczynski, P. & Sacchi, N. Analytical biochemistry 162, 156-159 (1987)). RNA was extracted using either a column-based (Qiagen QIAmp DSP Viral RNA Mini Kit, Cat #61904) or a magnetic bead-based method as described (DeAngelis, M. M., et al. Nucleic Acids Res 23, 4742-4743 (1995)). Reverse transcribed cDNA was amplified using primers and probes validated by the CDC or by Columbia University Personalized Medicine Genomics Laboratory, respectively, and approved by the FDA under the Emergency Use Authorization. Viral RNA was considered detected if the cycle threshold (Ct) for two viral primers/probes were <40.

Blood Samples Processing and Storage.

Peripheral Blood Mononuclear Cells (PBMCs) were obtained by gradient centrifugation and stored in liquid nitrogen in the presence of FCS and DMSO. Heparinized plasma and serum samples were aliquoted and stored at −20° C. or less. Prior to experiments, aliquots of plasma samples were heat-inactivated (56° C. for 1 hour) and then stored at 4° C.

High Throughput Automated Serology Assays

Plasma samples from 80 out of 87 participants were tested by high throughput automated serology assays. The Roche Elecsys anti-SARS-CoV-2 assay was performed on Roche Cobas e411 (Roche Diagnostics, Indianapolis, Ind.). The Elecsys anti-SARS-CoV-2 assay uses a recombinant protein representing the N antigen for the determination of antibodies against SARS-CoV-2. This assay received Emergency Use Authorization (EUA) approval from the United States Food and Drug Administration (FDA) (Roche Diagnostics. Elecsys Anti-SARS-CoV-2. FDA https://www.fda.gov/media/137605, 1-7 (2020).). The Pylon COVID-19 IgG and IgM assays were used to measure plasma IgG and IgM antibodies against SARS-CoV-2, respectively. Plasma samples were assayed on the Pylon 3D analyzer (ET HealthCare, Palo Alto, CA) as previously described (Yang, H. S. et al. Clin Chim Acta 509, 117-125 (2020).). This assay was implemented clinically as a laboratory-developed test under the New York State Department of Health regulations. Briefly, the assay was performed using a unitized test strip containing wells with pre-dispensed reagents. The COVID-19 reagent contains biotinylated recombinant versions of the SARS-CoV-2 S-Protein RBD and trace amounts of N protein as antigens that bind IgG and IgM, respectively. The cutoff values for both Pylon assays were determined using the mean of non-COVID-19 samples plus 6 Standard Deviations (SDs). The results of a sample are reported in the form of a cutoff index (COI) or an index value (IV), which were determined by the instrument readout of the test sample divided by instrument readout at cut off.

ELISAs

Validated ELISAs (Grifoni, A. et al. Cell 181, 1489-1501 e1415 (2020); Amanat, F. et al. Nat Med 26, 1033-1036 (2020).) to evaluate antibodies binding to SARS-CoV-2 RBD and additional RBDs were performed by coating of high-binding 96-half-well plates (Corning 3690) with 50 μl per well of a 1 μg/ml protein solution in PBS overnight at 4° C. Plates were washed 6 times with washing buffer (1×PBS with 0.05% Tween-20 (Sigma-Aldrich)) and incubated with 170 μl per well blocking buffer (1×PBS with 2% BSA and 0.05% Tween-20 (Sigma)) for 1 h at room temperature. Immediately after blocking, monoclonal antibodies or plasma samples were added in PBS and incubated for 1 h at room temperature. Plasma samples were assayed at a 1:67 starting dilution and 7 additional threefold serial dilutions. Monoclonal antibodies were tested at 10 μg/ml starting concentration and 10 additional fourfold serial dilutions. Plates were washed 6 times with washing buffer and then incubated with anti-human IgG, IgA or IgM secondary antibody conjugated to horseradish peroxidase (HRP) (Jackson Immuno Research 109-036-088 and 109-035-129) in blocking buffer at a 1:5,000 dilution. Plates were developed by addition of the HRP substrate, TMB (ThermoFisher) for 10 min (plasma samples) or 4 minutes (monoclonal antibodies), then the developing reaction was stopped by adding 50 μl 1 M $H_2SO_4$ and absorbance was measured at 450 nm with an ELISA microplate reader (FluoStar Omega, BMG Labtech) with Omega and Omega MARS software for analysis. For plasma samples, a positive control (plasma from patient COV72, diluted 66.6-fold and seven additional threefold serial dilutions in PBS) was added to every assay plate for validation. The average of its signal was used for normalization of all of the other values on the same plate with Excel software before calculating the area under the curve using Prism V8.4 (GraphPad). For monoclonal antibodies, the EC50 was determined using four-parameter nonlinear regression (GraphPad Prism V.8.4).

Expression of RBD Proteins

Mammalian expression vectors encoding the RBDs of SARS-CoV-2 (GenBank MN985325.1; S protein residues 319-539) and eight additional mutant RBD proteins (E484K, Q493R, R346S, N493K, N440K, V367F, A475V, S477N, and V483A) with an N-terminal human IL-2 or Mu phosphatase signal peptide were previously described (Barnes, C. O. et al. Cell 182, 828-842 e816, (2020).).

SARS-CoV-2 Pseudotyped Reporter Virus

SARS-CoV-2 pseudotyped particles were generated as previously described (Robbiani, D. F. et al. Nature 584, 437-442 (2020); Schmidt, F. et al. J Exp Med 217 (2020).). Briefly, 293T cells were transfected with pNL4-3ΔEnv-nanoluc and pSARS-CoV-2-$5_{\Delta 19}$. For generation of RBD-mutant pseudoviruses, pSARS-CoV-2-$S_{\Delta 19}$ carrying either of the following spike mutations was used instead of its wt counterpart: Q493R, R346S, or E484G (Weisblum, Y. et al. EbioRxiv 17, 1055-1042 (2020).). Particles were harvested 48 hpt, filtered, and stored at −80° C.

Pseudotyped Virus Neutralization Assay

Fourfold serially diluted plasma from COVID-19-convalescent individuals or monoclonal antibodies were incubated with SARS-CoV-2 pseudotyped virus for 1 h at 37° C. The mixture was subsequently incubated with 293TAce2 cells for 48 h after which cells were washed with PBS and lysed with Luciferase Cell Culture Lysis 5× reagent (Promega). Nanoluc Luciferase activity in lysates was measured using the Nano-Glo Luciferase Assay System (Promega) with the Glomax Navigator (Promega). The obtained relative luminescence units were normalized to those derived from cells infected with SARS-CoV-2 pseudotyped virus in the absence of plasma or monoclonal antibodies. The half-maximal inhibitory concentration for plasma ($NT_{50}$) or monoclonal antibodies ($IC_{50}$) was determined using four-parameter nonlinear regression (least squares regression method without weighting; constraints: top=1, bottom=0) (GraphPad Prism).

Biotinylation of Viral Protein for Use in Flow Cytometry

Purified and Avi-tagged SARS-CoV-2 RBD was biotinylated using the Biotin-Protein Ligase-BIRA kit according to manufacturer's instructions (Avidity) as described before (Robbiani, D. F. et al. Nature 584, 437-442 (2020).). Ovalbumin (Sigma, A5503-1G) was biotinylated using the EZ-Link Sulfo-NHS-LC-Biotinylation kit according to the manufacturer's instructions (Thermo Scientific). Biotinylated ovalbumin was conjugated to streptavidin-BV711 (BD biosciences, 563262) and RBD to streptavidin-PE (BD Biosciences, 554061) and streptavidin-AF647 (Biolegend, 405237).

Single-Cell Sorting by Flow Cytometry

Single-cell sorting by flow cytometry was described previously (Robbiani, D. F. et al. Nature 584, 437-442 (2020).). Briefly, peripheral blood mononuclear cells were enriched for B cells by negative selection using a pan-B-cell isolation kit according to the manufacturer's instructions (Miltenyi Biotec, 130-101-638). The enriched B cells were incubated in FACS buffer (1×PBS, 2% FCS, 1 mM EDTA) with the following anti-human antibodies (all at 1:200 dilution): anti-CD20-PECy7 (BD Biosciences, 335793), anti-CD3-APC-eFluro 780 (Invitrogen, 47-0037-41), anti-CD8-APC-eFluor 780 (Invitrogen, 47-0086-42), anti-CD16-APC-eFluor 780 (Invitrogen, 47-0168-41), anti-CD14-APC-eFluor 780 (Invitrogen, 47-0149-42), as well as Zombie NIR (BioLegend, 423105) and fluorophore-labelled RBD and ovalbumin (Ova) for 30 min on ice. Single CD3−CD8−CD14−CD16−CD20+Ova−RBD−PE+RBD−AF647+B cells were sorted into individual wells of 96-well plates containing 4 μl of lysis buffer (0.5×PBS, 10 mM DTT, 3,000 units/ml RNasin Ribonuclease Inhibitors (Promega, N2615) per well using a FACS Aria III and FACSDiva software (Becton Dickinson) for acquisition and FlowJo for analysis. The sorted cells were frozen on dry ice, and then stored at −80° C. or immediately used for subsequent RNA reverse transcription.

Antibody Sequencing, Cloning, and Expression

Antibodies were identified and sequenced as described previously (Robbiani, D. F. et al. Nature 584, 437-442 (2020).). In brief, RNA from single cells was reverse-transcribed (SuperScript III Reverse Transcriptase, Invitrogen, 18080-044) and the cDNA stored at −20° C. or used for subsequent amplification of the variable IGH, IGL, and IGK genes by nested PCR and Sanger sequencing. Sequence analysis was performed using MacVector. Amplicons from the first PCR reaction were used as templates for sequence- and ligation-independent cloning into antibody expression vectors. Recombinant monoclonal antibodies and Fabs were produced and purified as previously described (Robbiani, D. F. et al. Nature 584, 437-442 (2020).).

Computational Analyses of Antibody Sequences

Antibody sequences were trimmed based on quality and annotated using Igblastn v.1.14. with IMGT domain delineation system. Annotation was performed systematically using Change-0 toolkit v.0.4.540. Heavy and light chains derived from the same cell were paired, and clonotypes were assigned based on their V and J genes using in-house R and Perl scripts (FIG. 7). All scripts and the data used to process antibody sequences are publicly available on GitHub (https://github.com/stratust/igpipeline).

The frequency distributions of human V genes in anti-SARS-CoV-2 antibodies from this study were compared to Sequence Read Archive accession SRP01097041. The V(D)J assignments were done using IMGT/High V-Quest, and the frequencies of heavy and light chain V genes were calculated for 14 and 13 individuals, respectively, using sequences with unique CDR3s. The two-tailed t-test with unequal variances was used to determine statistical significance (FIG. 7).

Nucleotide somatic hypermutation and CDR3 length were determined using in-house R and Perl scripts. For somatic hypermutations, IGHV and IGLV nucleotide sequences were aligned against their closest germlines using Igblastn, and the number of differences were considered nucleotide mutations. The average mutations for V genes was calculated by dividing the sum of all nucleotide mutations across all patients by the number of sequences used for the analysis. To calculate the GRAVY scores of hydrophobicity, the Guy H. R. Hydrophobicity scale was used based on free energy of transfer (kcal/mole) implemented by the R package Peptides (the Comprehensive R Archive Network repository; https://journal.r-project.org/archive/2015/RJ-2015-001/RJ-2015-001.pdf). 532 heavy chain CDR3 amino acid sequences from this study and 22,654,256 IGH CDR3 sequences from the public database of memory B cell receptor sequences were used. The Shapiro-Wilk test was used to determine whether the GRAVY scores are normally distributed. The GRAVY scores from all 532 IGH CDR3 amino acid sequences from this study were used to perform the test, and 5,000 GRAVY scores of the sequences from the public database were randomly selected. The Shapiro-Wilk P values were 6.896×10-3 and 2.217×10-6 for sequences from this study and the public database, respectively, indicating that the data were not normally distributed. Therefore, we used the Wilcoxon nonparametric test to compare the samples, which indicated a difference in hydrophobicity distribution (P=5×10-6) (FIG. 10).

Biopsies and Immunofluorescence

Endoscopically obtained mucosal biopsies were formalin fixed and paraffin embedded. Sections (5 μm) were cut, dewaxed in xylene, and rehydrated in graded alcohol and phosphate-buffered saline (PBS). Heat-induced epitope retrieval was performed in target retrieval solution (Dako, S1699) using a commercial pressure cooker. Slides were then cooled to room temperature, washed in PBS, and permeabilized for 30 minutes in 0.1% Triton X-100 in PBS. Non-specific binding was blocked with 10% goat serum (Invitrogen, 50062Z) for 1 hour at room temperature. Sections were then incubated with a combination of primary antibodies diluted in blocking solution overnight at 4° C. Slides were washed 3 times in PBS and then incubated in secondary antibody and 4',6-diamidino-2-phenylindole (1 ug/mL) for 1 hour at room temperature. Sections were washed in PBS 3 times and then mounted with Fluoromount-G (Electron Microscopy Sciences, 1798425). Controls included, omitting primary antibody (no primary 995 control), or substituting primary antibodies with non-reactive antibodies of the same isotype (isotype control). A Nikon Eclipse Ni microscope and digital SLR camera (Nikon, DS-Qi2) was used to visualize and image the tissue.

The antibody used to stain sections for N protein was raised in rabbits against SARS-CoV N and is cross-reactive with SARS-CoV-2 N protein (Spiegel, M. et al. J Virol 79, 2079-2086 (2005).).

TABLE 8

Reagent Used in this Example.

| Antigen | Clone | Vendor | Catalog number | Host species | Conjugate | Dilution |
|---|---|---|---|---|---|---|
| ACE2 | Polyclonal | Abcam | ab15348 | rabbit | unconjugated | 1:1000 |
| EPCAM | SPM491 | GeneTex | GTX34693 | mouse | unconjugated | 1:100 |
| SARS-CoV-2 nucleocapsid | Polyclonal | N/A | N/A | rabbit | unconjugated | 1:2000 |
| No known specificity (isotype control) | Polyclonal | Abcam | ab37415 | rabbit | unconjugated | variable |
| Yeast GAL4 (isotype control) | 15-6E10A7 | Abcam | ab170190 | mouse | unconjugated | variable |
| Mouse IgG H&L | Polyclonal | Abcam | ab150116 | goat | Alexa Fluor 594 | 1:1000 |
| Rabbit IgG H&L | Polyclonal | Abcam | ab150077 | goat | Alexa Fluor 488 | 1:1000 |

Electron Microscopy and Dual-Axis Tomography

Tissues samples were fixed with 3% glutaraldehyde to meet biosafety requirements. Tissues were rinsed with cold 0.1M sodium cacodylate trihydrate+5% sucrose and further dissected to block sizes sufficient for embedding and sectioning. Tissues were postfixed for 1 h with cold 2% osmium tetroxide in cacodylate buffer, en bloc stained with 1% aqueous uranyl acetate, dehydrated with acetone and embedded in Epon-Araldite resin (Electron Microscopy Sciences). Samples were flat-embedded between two Teflon-coated glass microscope slides and the resin polymerized at 60° C. for 24 h. Embedded tissue blocks were observed by light microscopy to ascertain preservation quality and select regions of interest (i.e., apical epithelium). Blocks were extracted with a scalpel and glued to plastic sectioning stubs prior to sectioning. Semi-thin (150 nm) serial sections were cut with a UC6 ultramicrotome (Leica Microsystems) using a diamond knife (Diatome, Ltd. Switzerland). Sections were placed on formvar-coated copper-rhodium slot grids (Electron Microscopy Sciences) and stained with 3% uranyl acetate and lead citrate. Colloidal gold particles (10 nm) were placed on both surfaces of the grids to serve as fiducial markers for tomographic image alignment. Grids were placed in a dual-axis tomography holder (Model 2010, E. A. Fischione Instruments, Export PA) and imaged with a Tecnai G2 T12 transmission electron microscope (120 KeV; ThermoFisher Scientific). Images were recorded with a 2 k×2 k CCD camera (XP1000; Gatan, Pleasonton, CA). Tomographic tilt series and large-area montages were acquired automatically using the SerialEM software package (Mastronarde, D. N. A. J Struct Biol 152, 36-51 (2005).). For dual-axis tomography, images were collected at 1° intervals as samples were tilted +/−62°. The grid was then rotated 90°, and a second tilt-series was acquired about the orthogonal axis. Tomograms were calculated, analyzed, and modeled using the IMOD software package (Mastronarde, D. N. & Held. J Struct Biol 197, 102-113 (2017); Mastronarde, D. N. Journal of microscopy 230, 212-217 (2008).) on MacPro and iMac Pro computers (Apple, Inc).

Presumptive SARS-CoV-2 virions were identified from tomographic reconstructions of tissue samples by observing structures resembling virions described in cryo-electron tomography studies of purified SARS-CoV-2 and SARS-CoV-2 in infected cells. We used the following criteria for SARS-CoV-2 virion identification in tissues: (i) Structures that were spherical in 3D and not continuous with other adjacent structures with ~60-120 nM diameters, (ii) Spherical structures with densities corresponding to a distinct membrane bilayer, internal puncta consistent with ribonucleoproteins and densities corresponding to surface spikes on the external peripheries of the spheres.

Code Availability

Computer code to process the antibody sequences is available at GitHub (https://github.com/stratust/igpipeline).

The foregoing examples and description of the preferred embodiments should be taken as illustrating, rather than as limiting the present invention as defined by the claims. As will be readily appreciated, numerous variations and combinations of the features set forth above can be utilized without departing from the present invention as set forth in the claims. Such variations are not regarded as a departure from the scope of the invention, and all such variations are intended to be included within the scope of the following claims. All references cited herein are incorporated by reference in their entireties.

TABLE 9

Sequence pairs of antibody heavy and light chain variable regions from six individuals at 1.3 and 6.2 month time points.

| | Heavy Chain | | | | | Light Chain | | | | | |
|---|---|---|---|---|---|---|---|---|---|---|---|
| Time point | SEQUENCE_ ID | SEQ ID NO | aa | SEQ ID NO | cdr3_aa | SEQUENCE_ ID | SEQ ID NO | aa | SEQ ID NO | cdr3_aa | |
| 6.2M | COVD21_mo6_HC_P1A10-p1369 | 323 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDTPGGDDILTGWGLYGMDVWGQGTTVTVSS | 324 | AKDTPGGDDILTGWGLYGMDV | COVD21_mo6_K_P1A10-p1389 | 325 | DIQMTQSPSSLSASVGDRVTITCQASQDISNYLNWYQHHPGKAPKLLIHDASILETGVPTRFSGTGSGTKFTFTISSLQPEDIATYYCQQYHYLPPHFGPGTKVDSK | 326 | QQYHYLPPH | |
| 6.2M | COVD21_mo6_HC_P1C10-p1369 | 327 | QVQLVESGGGLVKPGGSLRLSCAASGFTFSDYCVTWIRQAPGKGLEWLSYSNTNDSSRSYADSVKGRFTISRDNAKNSLYLQMDSLRAEDTAVYYCARRGDGNVPLFHYYYMDVWGKGTTVTVSS | 328 | ARRGDGNVPLFHYYYMDV | COVD21_mo6_L_P1C10-p1409 | 329 | QSVLTQPPSASGTAGQRVTISCSGGSSNIGSNTVHWYQQLPGTAPKLLIYSNYKRPSGVPDRFSGSKSGASASLAISGLQSEDEAEYYCAAWDDSANGPIFGGGTKLTVL | 330 | AAWDDSANGPI | LAMBDA |
| 6.2M | COVD21_mo6_HC_P2G9-p1369 | 331 | QVQLVQSGAEVGKPGSSVRLSCKASRGTFNIYSISWLRQSPGQGLEWVGVITPLFGSSNYAHEFQGRVTLTADESTNTAYMDLSSLTSEDTALYYCATGGESGTSWFDPWGQGTLLTVSS | 332 | ATGGESGTSWFDP | COVD21_mo6_L_P2G9-p1409 | 333 | QSVLTQPPSASGTPGQRVTISCSGSSSNIGSHPVHWYQQLPGMAPKLLIYISNQRPSGVPDRFSGSKSGTSASLAISGLQSEDEADYYCAAWDDSQNGWVFGGGTKLTVL | 334 | AAWDDSQNGWV | LAMBDA |
| 6.2M | COVD21_mo6_HC_P1A5-p1369 | 335 | QVQLVQSGAEVKKPGASVKVSCKASGYTFTYYYMHWVRQAPGQGLEWMGIINPSGGSTSYAQKFQGRVTMTRDTSTSTVYMELSSLRSEDTAVYYCARPLLPGETGSLNRLDYWGQGTLVTVSS | 336 | ARPLLPGETGSLNRLDY | COVD21_mo6_L_P1A5-p1409 | 337 | QSVLTQPPSVSEAPRQRVTISCSGSSANIENNGVNWYQQLPGKAPKLLIYNDDLLFSGVSDRFSGSKSGTSASLAISGLQSEDEADYYCATWDDSLNGPVFGGGTKLTVL | 338 | ATWDDSLNGPV | LAMBDA |
| 6.2M | COVD21_mo6_HC_P2C5-p1369 | 339 | QVQLVQSGAEVKKPGSSVKVSCKASGDTFSSHAINWVRQAPGQGLEWMGRSIPMLGVTTSAQKFKGRVTITADHSTSTVFMDLSSLRSDDTAIYYCARGVVGATPGSFDLWGQGTMVTVSS | 340 | ARGVVGATPGSFDL | COVD21_mo6_L_P2C5-p1409 | 341 | QSVLTQPASVSGSPGQSITISCTGTSSDVGNYNLVSWYQQHPGKAPKLMIYGVSKRPSGVSYRFSGSKSANTASLTISGLQAEDEADYYCCSYAGSSVIFGGGTKLTVL | 342 | CSYAGSSVI | LAMBDA |
| 6.2M | COVD21_mo6_HC_P1F3-p1369 | 343 | QVQLQESGPGLVKPSQTLSLTCSVSGASISNADYYWSWIRQPPGKGLEWIGYIYYSGTSYYNPSLKSRVTISVDTSKNQFSLKLSSVTAADTAVYYCARELRWSLGGGASYWGQGTLVTVSS | 344 | ARELRWSLGGGASY | COVD21_mo6_L_P1F3-p1409 | 345 | QSVLTQPASESGSPGQSITISCTGTSSDVGSYNLVSWYQQHPGKAPKLMIYEGIKRPSGVSNRFSGSKSGNTASLTISGLQAEDEADYYCCSYAGSTNVIFGGGTKLTVL | 346 | CSYAGSTNVI | LAMBDA |
| 6.2M | COVD21_mo6_HC_P1H10-p1369 | 347 | EVQLLESGGDLVHPGGSLRLSCAASGFTFRSYAMSWVRQAPGKGLEWVSSVSGAGGSTYYADSVKGRFTISRDNSKNTLFMHMNSLRAEDTAVYYCVRTRMDYYDSIGYPWAFEIWGQGTMVTVSS | 348 | VRTRMDYYDSIGYPWAFEI | COVD21_mo6_L_P1H10-p1409 | 349 | QSVLTQPASESGSPGQSITISCTGTNSDVGSYDLVSWYQQHPGKAPKLIIYEVNKRPSGVSSRFSGSKSGNTASLTISGLQIEDEADYYCCSYAGTWLFGGGTRLTVL | 350 | CSYAGTWL | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COVD21_mo6_HC_P1F5-p1369 | 351 | QVQLVESGGGVVQPGGSLRLSCAASGFTFSNHGMHWVRQAPGKGLEWVAVMSYDGSNEDYSASVKGRFTISRDNSKNTLSLQMNSLRPEDTAVYYCASEDYYDSSGSFDNWGQGTLVTVSS | 352 | ASEDYYDSSGSFDN | COVD21_mo6_L_P1F5-p1409 | 353 | QYVLTQPRSVSGSPGQSVTISCTGTSSDVGGSNYVSWYQQHPGKAPKVMVYDVRKRPSGVPDRFSGSKSGNTASLTISGLQPEDEADYYCCSYAGTYTWVFGGGTTLTVL | 354 | CSYAGTYTWV | LAMBDA |
| 6.2M | COVD21_mo6_HC_P2B7-p1369 | 355 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDTPGGDDILTGWGLYGMDVVVGQGTTVTVSS | 356 | AKDTPGGDDILTGWGLYGNIDV | COVD21_mo6_L_P2B7-p1409 | 357 | QSVLTQPASVSGSPGQSITISCTGTSSDVGSYNLVSWYQQYPGKAPKLMIYEVSKRPSGVSNRFSGSKSGNTASLTISGLRAEDEADYYCCSYVGSSTRVFGGGTKLTVL | 358 | CSYVGSSTRV | LAMBDA |
| 6.2M | COVD21_mo6_HC_P1H5-p1369 | 359 | QVQLVQSGAEVKKPGASVTVSCKASGYIFTDYYMHWVRQAPGQGLEWMGWINPNSGGANYAQKFQGRISMTTDTSVTTGYMDLSRLRSDDTAVYYCAIKPPTYHFDNNGYHLPYDYVDVVVGTGTTVTVAS | 360 | AIKPPTYHFDNNGYHLPYDYVDV | COVD21_mo6_L_P1H5-p1409 | 361 | QSVLTQPPSVSAAPGQKVTISCSGSSSNIGNYYVSWYQQLPGTAPKLLIYDNNKRPSGIPDRFSGSKSGTSATLGITGLQTGDEADYYCGTWDNSLSTDWVFGGGTKLTVL | 362 | GTWDNSLSTDWV | LAMBDA |
| 6.2M | COVD21_mo6_HC_P1C1-p1369 | 363 | QVQLVQSGAEVKKPGTSVKVSCKASGYTFTDYFMHWVRQAPGQGLEWMGWINPNSGGTNYAQNFQGRVTMTSDTSITTAYMELSRLRSDDTAVYYCAIKPPIYYYDSSGSFLSYYYMDVVVGKGTTVTVS | 364 | AIKPPIYYYDSSGSFLSYYYMDV | COVD21_mo6_L_P1C1-p1409 | 365 | QSVLTQPPSVSAAPGQKVSISCSGSSSNIGNHYVSWYQQFPGTAPKLLIYDNNKRPSGIPDRFSGSKSGTSATLGIAGLQTGDEADYYCGTWDSSLSADWVFGGGTKLTVL | 366 | GTWDSSLSADWV | LAMBDA |
| 6.2M | COVD21_mo6_HC_P1F11-p1369 | 367 | QVQLVQSGTELVKPGASVNLSCKASGYTFTSYWMHWVKQRPGQGLEWIGNINPSNGGTNYNEKFKNKATLTVDKSSSTAYMQLSSLTSEDSAVYYCARPPYYSNFLFVYWGQGTTVTVSS | 368 | ARPPYYSNFLFVY | COVD21_mo6_L_P1F11-p1409 | 369 | QSVLTQEPSLTVSPGGTVTLTCASSTGAVTSDSYPNWFQQKPGQPPRALIYSTSNKHSWTPARFSGSLLGGKAALTLSGVQPEDEADYYCLLYDGDAVLFGGGTKLTVL | 370 | LLYDGDAVL | LAMBDA |
| 6.2M | COVD21_mo6_HC_P2A9-p1369 | 371 | EVQLLESGGGLVQPGGSLRLSCAGSGFTFSHYALSWVRQAPGKGLEWVSCISGTGGNSHYADSVKGRFTSSRDNSKNILYLQMNSLRAEDTAVYFCAKGGDFWSGYLIPFDSWGQGTLVTVS | 372 | AKGGDFWSGYLIPFDS | COVD21_mo6_L_P2A9-p1409 | 373 | SYVLTQSPSVSVAPGKTARITCGGDSIGSKNVHWYQQKPGQAPVLVMYYDNDRPSGIPERFSGYNSGNTATLSISRVEAGDEADYYCLVWDGSGDPWVFGGGTKLTVL | 374 | LVWDGSGDPWV | LAMBDA |
| 6.2M | COVD21_mo6_HC_P1C7-p1369 | 375 | QVQLVQSGAEVKKPGASVKVSCKTSGYLFTGYYIHWVRQAPGHGLEWMGWVNPNSGATNNTQKFQGRITMTRDTSITTVHMELSRLKSDDTAVYYCARDFDFSVVSNAFDIWGQGTMVTVSS | 376 | ARDFDFSVVSNAFDI | COVD21_mo6_L_P1C7-p1409 | 377 | QSVLTQPPSASGSPGQSVTISCTGTSSDVGGYNYVSWYQQHPDKAPKLMIYEVSKRPSGVPDRFSGSKSGNTASLTVSGLQAEDEADYYCNSYAGNNILVFGGGTKLTVL | 378 | NSYAGNNILV | LAMBDA |
| 6.2M | COVD21_mo6_HC_P1D11-p1369 | 379 | QVQLVQSGAEVKKPGASVKVSCKASGYLFTGHYIHWVRQAPGQGLEWMAWINPNSGATNYTQKFQGRVTMTRDTSITTTFMELSRLRSDDTAVYYCARDLGWSRVQGSLDIWGQGTIVTVSS | 380 | ARDLGWSRVQGSLDI | COVD21_mo6_L_P1D11-p1409 | 381 | QSVLTQPPSASGSPGQSVTISCTGTSSDVGGYDFVSWYQQHPGKAPKLIIYEVNQRPSGVPDRFSGSKSGDSASLTVSGLQTEDEADYYCNSYAGNNNWVFGGGTKLTVL | 382 | NSYAGNNNWV | LAMBDA |
| 6.2M | COVD21_mo6_ | 383 | QVQLVQSGAEVKKPGASVMVSCRTSGYRITDYYIHWVRQAPGQGLEWMGWINPISGGTNYAQ | 384 | ARGTFYYDSSGYYI | COVD21_mo6_ | 385 | QSVLTQPPSASGSPGQSVTISCTGTSSDVGGYNYVSWYQQHPGKAPKLLIYEV | 386 | SNYAGS | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | HC_P1F7-p1369 | | KFQGRVTMTRDTSILTAYMELTRLRSDDTAVYYCARGTFYYDSSGYYIDYWGQGTLVTVSS | | DY | L_P1F7-p1409 | | SKRPSGVPDRFSASKSGNTASLTVSGLQAEDEADYYCNSYAGSNNPVVFGGGTKLTVL | | NNPVV | |
| 6.2M | COVD21_mo6_HC_P2B1-p1369 | 387 | QVQLVQSGVEVKKPGASVKVSCKSSGYTFTSYGINWVRQAPGQGLEWMGWINGYNGNTNYAQKFQGRVTMTSDTSTSTAYMQLSSLRSDDTAVYFCARGVISMVRGVPSLPQYNYGMDVWGQGTTVTVSS | 388 | ARGVISMVRGVPSLPQYNYGMDV | COVD21_mo6_L_P2B1-p1409 | 389 | SYVLTQPPSVSVSPGQTASITCSGDDLGDKYACWYQQKPGQSPVLVIYHDFKRPSGIPERFSGSKSGNTATLTVSGTQAMDEADYYCQAWDSSTGVFGTGTKVTVL | 390 | QAWDSSTGV | LAMBDA |
| 6.2M | COVD21_mo6_HC_P2A8-p1369 | 391 | QVQLVQSGAEVGKPGSSVKVSCKAPSGTFNIYSISWLRQSPGQGLEWVGAITPLFSSSNYAHKFQHRVTITADEATNTAYMELSSLTSEDTALYYCATGGESETTWFDPWGQGTLVTVSS | 392 | ATGGESETTWFDP | COVD21_mo6_L_P2A8-p1409 | 393 | SYVLTQKPSVSVAPERAACLTCGGDNVASKDVQWCQLRPGQAPVVVIYSDSDRPPETPDRFSGSNSGNTASLTTSRVEAGDEADYYCQLCHSASGHPWVFGGGTNLTVL | 394 | QLCHSASGHPWV | LAMBDA |
| 6.2M | COVD21_mo6_HC_P1F10-p1369 | 395 | EVQLVESGGGLVQPGGSLRLSCAASGFTFSSYWHMWVRQAPGKGLVWVSRINSYGSITNYADSVKGRFTISRDNAKNTLYLQMNSLRAEDTAVYYCARELFRTIDPWGQGTLVTVSS | 396 | ARELFRTIDP | COVD21_mo6_L_P1F10-p1409 | 397 | NFMLTQPHSVSESPGKTVTISCTGSSGSIASNYVQWYQQRPGSAPTTVIYEDNQRPSGVPDRFSGSIDSSSNSASLTISGLKTEDEADYYCQSFDSSSVVFGGGTKLTVL | 398 | QSFDSSSVV | LAMBDA |
| 6.2M | COVD21_mo6_HC_P2C3-p1369 | 399 | QVQLVESGGGVVQPGRSLRLSCVASGITFRTYAMHWVRQAPGKGLEWVAVISYDGSNRHYADSVKGRFTISRDNSKNTLSLQMNSLRTEDTAVYYCATTLPNYWGRGTLVTVSS | 400 | ATTLPNY | COVD21_mo6_L_P2C3-p1409 | 401 | NFMLTQPHSVSESPGKTVTISCTGSSGSIATNYVQWFQQRPGSAPTTVIYEDNQRPSGVPDRFSGSIDSSSNSASLTISGLKTEDEADYYCQSFDSSYWVFGGGTKLTVL | 402 | QSFDSSYWV | LAMBDA |
| 6.2M | COVD21_mo6_HC_P2E10-p1369 | 403 | EVQLVESGGGLVQPGESLRLSCAGSGFTFSSHWMSWVRQAPGKGLEWVANIKEDGSADFYVDSVKGRFTISRDSAKNSLFLQMNSLRAEDTAVYYCARAVTGWFLGIDFWGQGTLVTVSS | 404 | ARAVTGWFLGIDF | COVD21_mo6_L_P2E10-p1409 | 405 | NFMLTQPHSVSESPGKTVTISCTCSGGTIALNYVQWYQQRPGSAPTTVIYEDNQRPSGVPDRFSGSVDSSSNSASLSISGLKTEDEADYYCQSYDGNYHWVFGGGTKLTVL | 406 | QSYDGNYHWV | LAMBDA |
| 6.2M | COVD21_mo6_HC_P1B3-p1369 | 407 | EVQLVESGGGLVQPGGSLRLSCAASGFTFSSYWMIWVRQAPGKGLEWVANIKLDGSEKKYVDSVKGRFTISRDNAKNSLYLQMNSLRAEDTAVYYCARASYYYGWFDPWGQGTLVTVSS | 408 | ARASYYYGWFDP | COVD21_mo6_L_P1B3-p1409 | 409 | NFMLTQPHSVSESPGKTVTISCTGSSGSIASNYVQWYQQRPGSAPTNVIYEDNQRPSGVPDRFSGSIDSSSNSASLTISGLKTEDEADYYCQSYDGTNLWVFGGGTKLTVL | 410 | QSYDGTNLWV | LAMBDA |
| 6.2M | COVD21_mo6_HC_P2C2-p1369 | 411 | QVQLVESGGGLVKPGGSLRLSCAASGFTFSDYYMSWIRQAPGKGLECVSYISTSGSAKNCADSVMGRFTISRDNAKNSLFLQMNSLRAEDTAVYYCAGQKWLRAPFDYWGQGILVTVSS | 412 | AGQKWLRAPFDY | COVD21_mo6_L_P2C2-p1409 | 413 | NFMLTQPHSVSESPGKTVTISCTGSGGSIASNYVQWYQQRPGSAPRNVIYEDSQRPSGVPDRFSGSIDSSSNSASLTISGLKTEDEADYYCQSYDNIYHYVFGTGTQVTVL | 414 | QSYDNIYHYV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COVD21_mo6_HC_P2H11-p1369 | 415 | EVQLVQSGSEVKKPGESLKISCKASGYSFSYYWIGWVRQMPGKGLDWMGIIYPGDSATRYSPSFQGQVTISADKSISTAYLQWSSLKASDTAMYYCARLSYGHSGYTTVEDWFDPWGQGTLVTVSS | 416 | ARLSYGHSGYTTVEDWFDP | COVD21_mo6_L_P2H11-p1409 | 417 | QSVLTQPPSVSGAPGQRVTISCAGSSSNIGAGFDVQWYQQLPGRAPKLLIFGNNNRPSGIPARFSGSKSGTSGSLAITGLQAEDEADYYCQSYDSRLSASVFGGGTKLTV | 418 | QSYDSRLSASV | LAMBDA |
| 6.2M | COVD21_mo6_HC_P1B4-p1369 | 419 | EVQLLESGGGLLQPGGSLRLSCAASGFTFSSYVMSWVRQAPGKGLEWVSSISGSGGGTYYADSVKGRFTISRDNSKNTLFLQMNSLRAEDTAVYYCAKHPVMAALGDVYYYYGMDVWGQGTTVTVSS | 420 | AKHPVMAALGDV | COVD21_mo6_L_P1B4-p1409 | 421 | SVLTQPPSVSGAPGQRVTISCTGSSSNFGAGYDVHWYQLLPGTAPKLLMYGNSDRPSGVPDRFSGSKSGTSASLAITGLQAEDEADYYCQSYDSSLSGWVFGGGTKLTVL | 422 | QSYDSSLSGWV | LAMBDA |
| 6.2M | COVD21_mo6_HC_P1E1-p1369 | 423 | QVQLVQSGAELKKPGASVRVSCKASGYTFTDYYIHWVRQAPGQGFEWMGWINPDSGGTNYPQNFQGRVTMTRGTSISTAYVELTRLRFDDTAVYYCARTSSPHSSSTGDLDYWGQGTLVTVS | 424 | ARTSSPHSSSTGDLDY | COVD21_mo6_L_P1E1-p1409 | 425 | SYVLTQSPSVSVAGKTARITCGGRDIGSKSVHWYQQRPGQAPVLVISYDNDRPSGIPERFSGSNSGNTATLTISRVEAGDEADYYCQVWDGTGDHPGWVFGGGTRLTVL | 426 | QVWDGTGDHPGWV | LAMBDA |
| 6.2M | COVD21_mo6_HC_P2E9-p1369 | 427 | QVQLVQSGAEVKKPGSSVKVSCKASGGTFSSYAISWVRQAPGQGLEWMGGIVPIFGSANYAQKFQGRVTITADESTSTANMELRSLRFEDTAVYYCARGGYCVGGTCQDWFDPWGQGTLVIVSS | 428 | ARGGYCVGGTCQDWFDP | COVD21_mo6_L_P2E9-p1409 | 429 | SYVLTQPPSVSVAPGKTARITCGGIDIGSKSVHWYQQKPGQAPLLVIYYDNDRPSGIPERLSGSNSGNTATLTISRVEAGDEADYYCQVWDGTSDHPAYVFGTGTKVSVL | 430 | QVWDGTSDHPAYV | LAMBDA |
| 6.2M | COVD21_mo6_HC_P1B8-p1369 | 431 | QVQLVESGGGVVQPGRSLRLSCAASGFTFSNYDMHWVRQAPGKGLEWVAFISYDGGNKHSADSVKGRFSISRDNSKNTLYLQMNSLRPEDTAVYYCAHHQGGGTGVYYSDPFDSWGQGTLVTVSS | 432 | AHHQGGGTGVYYSDPFDS | COVD21_mo6_L_P1B8-p1409 | 433 | SYVLTQPPSVSVAPGKTATITCGGDSVGSKSVHWYQQKSGQAPVLVISYDNDRPSGIPDRFSGSNSGNTATLTISRVEAGDEADYHCQVWDISPVFGGGTKLTVL | 434 | QVWDISPV | LAMBDA |
| 6.2M | COVD21_mo6_HC_P1H2-p1369 | 435 | QVQLVQSGAEVKKPGASVKVSCKASGYTFSHYDINWVRQATGQGLEWMGWMNPNSGNTGYAQKFQGRVTLTKNTSISTVYMELRSLTSEDTAVYYCARGLSILAVSEDWFDPWGPGTLVTVSS | 436 | ARGLSILAVSEDWFDP | COVD21_mo6_L_P1H2-p1409 | 437 | SYVLTQPPSVSVAPGKTARITCGGNNIGGKRIYWYQQKPGQAPVLVIYYNNDRPSGIPERFSGSNSGNTATLTISRVEAGDEADYYCQVWDNSIDHYIFGTGTKVTV | 438 | QVWDNSIDHYI | LAMBDA |
| 6.2M | COVD21_mo6_HC_P2H3-p1369 | 439 | EVQLLESGGALVQPGGSLRLSCAASGFTFSIFAMSWVRQAPGKGLEWVSTISDVSTYYADSVKGRFTISRDNSKNTLYLQMNGLRAEDTAVYYCAKTIDTFFFDHWGQGTLVTVSS | 440 | AKTIDTFFFDH | COVD21_mo6_L_P2H3-p1409 | 441 | SYVLTQPPSVSVAPGKTARITCGGNNIGSKSVYWYQQKPGQAPVLVIYYDSDRPSGIPERFSGSNSGNTATLTISGVEAGDEADYYCQVWDSSSDHWVFGGGTKLTVL | 442 | QVWDSSSDHWV | LAMBDA |
| 6.2M | COVD21_mo6_HC_P1D10-p1369 | 443 | EVQLVESGGGLVQPGGSLRLSCAASGFTFSTYSMNWVRQAPGKGLEWVSYISSSSSTIHYADSVKGRFTISRDNAKNSLYLQMNSLRDEDTAVYYCAREAHDGALTDYGDYLNWFDPWGQGTLVTVSS | 444 | AREAHDGALTDYGDYLNWFDP | COVD21_mo6_L_P1D10-p1409 | 445 | SYVLTQPPSVSVAPGKTARITCGGTNIGSKNVHWYQQKPGQAPVLVIYYDNDRPSGIPERFSGSNSGNTATLTISRVEAGDEADYYCQVWDTTSDHFYWVFGGGTKLTVL | 446 | QVWDTTSDHFYWYV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COVD21_mo6_HC_P2C7-p1369 | 447 | QVQLVQSGAEVKKPGASVRVSCKASGYTFTTYDINWVRQASGQGLEWMGWMNPDSGNTGYAQKFQGRVTMTRNISISTAYLDLSSLQSDDTAVYYCARDYGSGSYYRGNWFDPWGQGTLVIVSS | 448 | ARDYGSGSYYRGNWFDP | COVD21_mo6_L_P2C7-p1409 | 449 | QSALTQPPSASGSPGQSVTISCTGTSSDVGGYNYVSWYQQHPGKAPKLMIYEVSGVPDRFSGSKSGNTASLTVSGLQAEDEAEYYCSSDAGSNNVVFGGGTKLTVL | 450 | SSDAGSNNVV | LAMBDA |
| 6.2M | COVD21_mo6_HC_P1E3-p1369 | 451 | QVQLVQSGAEVRKPGASVKVSCMASGYTFNTYDINWVRQGTGQGLEWMGWMNPNSGNTGHAQKFQGRVAMTVNTSMNTAYMELSSLRSEDTAVYYCARGADMLNVAVGADFDYWGQGTLVTV | 452 | ARGADMLNVAVGADFDY | COVD21_mo6_L_P1E3-p1409 | 453 | QSVLTQPPSASGSPGQSVTISCTGTSSDVGGYNFVSWFQQHPGKAPKLMIYEVSGVPDRFSGSKSANTASLTVSGLQAEDEADYFCSSYAGSNNWVFGGGTKLTVL | 454 | SSYAGSNNWV | LAMBDA |
| 6.2M | COVD21_mo6_HC_P1F8-p1369 | 455 | QVQLVESGGGVVQPGRSLRLSCVGSGFTFSNYAVHWVRQAPGKGLEWVTVISSDGGDKDYADAVKGRFTISRDNSKYKVYLEMKSLRGEDTAVYYCAREGSSGSYYTGFYSYMDVVVGKGTTVTVSS | 456 | AREGSSGSYYTGFYSYMDV | COVD21_mo6_L_P1F8-p1409 | 457 | QSVLTQPASVSGSPGQSITISCTGTSSDVGNYNYVSWYQQHPGKAPKVMIYDVDTRPSGVSDRFSGSKSGNTASLTISGLQPEDEADYYCSSYTSNSALANWVFG | 458 | SSYTSNSALANWV | LAMBDA |
| 6.2M | COVD21_mo6_HC_P1C9-p1369 | 459 | QVQLVQSGAEVKKPGASVKVSCKASGYTFTDHYMHWVRQAPGQGLEWMGWINPNTGGTNFAQKFQGRVTMTRDTSISTAYMELNRLRSDDTAVYYCARVGRLAPRPYYFYYYMDVVVGKGTTVTVSS | 460 | ARVGRLAPRPYYFYYYMD | COVD21_mo6_L_P1C9-p1409 | 461 | QSVLTQPASVSGSPGQSITISCTGTSSDVGDYNYVSWYQQYPGKAPKLMIYDVSNRPSGVSDRFSSKSGNTASLTISGLQAEDEADYYCSSYTSTTTLVFGTGTKVTVL | 462 | SSYTSTTTLV | LAMBDA |
| 6.2M | COVD21_mo6_HC_P2B10-p1369 | 463 | QVQLQESGPGLVKPSQTLSLTCTVSGGSISSGDYYWSWVRQPPGKGLEWIGYIYYTGITYYRPSLKSRVTISVDTSKNQFSLKLSSVTAADTAVFYCARVVRLWPRYFDSWGQGTLVTVSS | 464 | ARVVRLWPRYFDS | COVD21_mo6_L_P2B10-p1409 | 465 | QSVLTQPPSASGSPGQSVTISCTGTSSDVGTYDYVSWYQQHPGKAPKVIIYEVSRRPSGVPDRFSGSKSGNTASLTVSGLQAEDEAHYYCSTYAGSDNLEFGGGTKLTVL | 466 | STYAGSDNLE | LAMBDA |
| 6.2M | COVD21_mo6_HC_P2A2-p1369 | 467 | QVQLVQSGAEVKKPGSSVKVSCKASGGTFNSYALSWVRQAPGQGLEWMGGIIFIFDKPDYAQKFKGRLTITADESTNTVYMELSSLRSEDTAVYYCAREGGHTHPYYHGMDVVVGQGTTVTVYS | 468 | AREGGHTHPYYHGMDV | COVD21_mo6_L_P2A2-p1409 | 469 | QSVLTQPPSASGSPGQSVTISCTGTSSDVGGYNYVSWYQQHPGKAPKLMIYEVTKRPSGVPDRFSGSKSGNTASLTVSGLRPEDEADYYCTSYAGSITYVFGTGTKVSV | 470 | TSYAGSITYV | LAMBDA |
| 6.2M | COVD21_mo6_HC_P1C3-p1369 | 471 | EVQLVESGGGLVQPGRSLRLSCAASGFTFDDYAMHWVRQAPGKGLEWVSGISWNSGSMGYAESLKGRFTISRDNAKNSLYLQMNSLRAEDTALYYCAKPKKRGDYYGSGSFDYWGQGTLVTVSS | 472 | AKPKKRGDYYGSGSFDY | COVD21_mo6_L_P1C3-p1409 | 473 | QSVLTQPASVSGSPGQSITISCTGTNSDIGAYNFVSWYQQHPGKAPKLMIYDVNNRPSGVSSRFSGSKSGNTASLTISGLQAEDEADYYCTSYRMTSTVVFGGGTKLTVL | 474 | TSYRMTSTVV | LAMBDA |
| 6.2M | COVD21_mo6_HC_P1A12-p1369 | 475 | QLQLQESGPGLVKPSETLSLTCIVSGGSINSTTYYWDWIRQSPGKGLEWIGSIFYTGITYYSPSLKTRVTISVDTSKNQFSLRLNSMTAADTAVYYCARRLRQLWFGPWFDPWGQGTLVTVSS | 476 | ARRLRQLWFGPWFDP | COVD21_mo6_L_P1A12-p1409 | 477 | QSVLTQPPSASGSPGQSVTISCTGTRSDVGDYNYVSWYQQHPDKAPKLIIFEVTKRPSGVPDRFSGSKSGNTASLTVSGLQAEDEADYYCSSYAGSSNVMFGGGTKLTVL | 478 | SSYAGSSNVM | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 6.2M | COVD21_mo6_HC_P1D9-p1369 | 479 | QLQLQESGPGLVKPSETLSLTCTVSGGSISSTTYYWDWIRQSPGKGLEWIGSIFYTGITYYSPSLKSRVTISVDTSKNQFSLRLNSMTAADTAVYYCARRLRQLWFGPWFDPWGQGTLVTVSS | 480 | ARRLRQLWFGPWFDP | COVD21_mo6_L_P1D9-p1409 | 481 | QSVLTQPPSASGSPGQSVTISCTGTRSDVGDYNYVSWYQQHPDKAPKLIIYEVTKRPSGVPDRFSGSKSGNTASLTVSGLQAEDEADYYCSSYAGSNNVMFGGGTKLTVL | 482 | SSYAGSNNVM | LAMBDA |
| 6.2M | COVD21_mo6_HC_P1A1-p1369 | 483 | EVQLVESGGGLVKPGGSLRLSCAASGFTFSNVWMSWVRQAPGKGLEWVGRIKSKIDGGTTEYAAPVKGRFIISRDDSKNTLSLQMNSLKTEDTAVYYCTTDHGREPPVHWGQGTLVTVSS | 484 | TTDHGREPPVH | COVD21_mo6_K_P1A1-p1389 | 485 | EIVLTQSPGTLSLSPGERASLSCRARQSVYSNYLAWYQHKSGQAPRLLFYGASSRATDIPDRFSASGSGTDFTLTISRLEPEDFAVYYCLQYGPSPTFGPGTRLEIK | 486 | LQYGPSPT | KAPPA |
| 6.2M | COVD21_mo6_HC_P1A4-p1369 | 487 | EVQLVQSGAEVKKPGESLKISCKGSGFLFSRYWIGWVRQMPGKGLEWLGIIYSGDSDTRYSPSFQGQVTFSVDKSVNTAYLHWSSLKASDTAVYYCARTQHGVTDAFDIWGQGTMVTVSP | 488 | ARTQHGVTDAFDI | COVD21_mo6_K_P1A4-p1389 | 489 | DIQMTQSPSTLSASVGDRVTITCRASQSISSWLAWYQQKPGKAPKFLIYEASRLESGVPSRFSGSGSGIEFTLTINSLQPDDFATYYCQQYSNYSPTFGQGTKVEF | 490 | QQYSNYSPT | KAPPA |
| 6.2M | COVD21_mo6_HC_P1A6-p1369 | 491 | QVQLQESGPGLVKPSQTLSLTCTVSGGSISSGPYYWSWIRQHPGKGLEWIGYIYYSGSTYYNPSLKSRVTISVDTSKKQFSLNLNSVTAADTAVYYCARVWQYYDSTGSFDYWGQGTLVTVSS | 492 | ARVWQYYDSTGSFDY | COVD21_mo6_K_P1A6-p1389 | 493 | DIVMTQSPLSLPVTPGEPASISCRSSRGLLHSNGYNYLDWYLQKPGQSPQLLIYLGSNRASGVPDRFSGSGSVTDFTLNISRVEAEDVGVYYCMQALQTPFTFGPG | 494 | MQALQTPFT | KAPPA |
| 6.2M | COVD21_mo6_HC_P1A7-p1369 | 495 | QVQLVESGGGVVQPGRSLRLACAASGFTFGMHWVRRAPGKGLEWVAVIWHDGSNKYYADSVKGRFTISRDNSKSTLFLQMNSLRAEDTAVYYCARGDTSGWYALGLDVWGRGTTVTVSS | 496 | ARGDTSGWYALGLDV | COVD21_mo6_K_P1A7-p1389 | 497 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPYTFGQGTKLEIK | 498 | QQYGSSPPYT | KAPPA |
| 6.2M | COVD21_mo6_HC_P1A8-p1369 | 499 | EVQLVESGGGLAQPGRSLRLSCAASGFTFDDYAMHWVRQAPGKGLEWVSGINWNSGSLGYADSVKGRFTISRGIAKNSLYLQMNSLRPEDTAFYYCAKAGVRGIAAAGPDLNFDYWGQGTLVTVSS | 500 | AKAGVRGIAAAGPDLNFDY | COVD21_mo6_K_P1A8-p1389 | 501 | EIVLTQSPATLSLSPGERATLSCRASQSVSSYLAWYQQKPGQAPRLLIYDASNRATGIPARFIGSGSGTDFTLTISSLEPEDFAVYYCQQRITFGQGTRLEIK | 502 | QQRIT | KAPPA |
| 6.2M | COVD21_mo6_HC_P1B11-p1369 | 503 | QVQLVESGGGVVQPGRSLRLSCAASGFTFSSFAMHWVRQAPGKGLEWVAVISYDGSNKYYADSVQGRFTISRDNSKNTLSLQMNSLRAEDTAVYYCAKQLVSGGYGDLWFGGLDYWGQGTLVTVSS | 504 | AKQLVSGGYGDLWFGGLDY | COVD21_mo6_K_P1B11-p1389 | 505 | EIVLTQSPATLSLSPGERATLSCRASQSVSSFLAWYQQKPGQAPRLLIHDASDRATGIPARFSGSGSGTDFTLTISSLEPEDFAVYYCQQRSNWPQTFGQGTKVEIK | 506 | QQRSNWPQT | KAPPA |
| 6.2M | COVD21_mo6_HC_P1B9-p1369 | 507 | QVQLVESGGGVVRPGRSLRLSCAASGFTFNNYGMHWVRQAPGKGLEWVAVIGSDGHIKHYADSVKGRFTISRDNSKNTLYLQLNSLRAEDTAMYYCARDQSLEEFLVTWFDPWGQGTLVTVS | 508 | ARDQSLEEFLVTWFDP | COVD21_mo6_K_P1B9-p1389 | 509 | DIQMTQSPSSLSASVGDRVTITCRASQSISSYLNWYQQKPGKAPKLLIHAASSLQSGVPSRFSGSGSGTDFTLTINSLQPEDFATYYCQQSYNTPPWTFGQGTKVEIK | 510 | QQSYNTPPWT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COVD21_mo6_HC_P1C11-p1369 | 511 | QVQLVESGGGLVKPGGSLRLSCAVSGFTFSEYYMSWIRQAPEKGLEWVSHISSSGSTMYYADSVKGRFTISRDNAKNSLYLQMNSLRAEDTAVYYCATDRTKNSYDSSGGDYWGQGTLVTVSS | 512 | ATDRTKNSYDSSGGDY | COVD21_mo6_K_P1C11-p1389 | 513 | DVVMTQSPLSLPVTLGQPASISCRSSESLVYSDGNTYLSWFQQRPGQSPRRLIYKVSNRDSGVPDRFSGSGSGTDFTLKISRVEAEDVGVYYCMQGTHWPPYTFGQGTKLEIK | 514 | MQGTHWPPYT | KAPPA |
| 6.2M | COVD21_mo6_HC_P1C2-p1369 | 515 | QMQLVQSGPEVKKPGTSVKVSCKASGFTFYNSAVQWVRQARGQRLEWVGWIVVGSGNTDYAQKFQERVTMTRDLSTNTAYMEVNSLRSEDTAVYYCAAPYCSGGTCLDGFDIWGQGTMVTVSS | 516 | AAPYCSGGTCLDGFDI | COVD21_mo6_K_P1C2-p1389 | 517 | EIVLTQSPGTLSLSPGERGTLSCRASQSVRSNYLAWYKQRPGQAPRLLVYGASSRATGIPDRFSGSGSGTDFTLTISRLEPEDFAVYYCQQYGSSPWTFGQGTKVEI | 518 | QQYGSSPWT | KAPPA |
| 6.2M | COVD21_mo6_HC_P1C6-p1369 | 519 | EVQLVESGGGLIQPGGSLRLSCAASGITVSSNYMSWVRQAPGKGLEWVSVMYAGGSTFYADSVKGRFTISRDDSKNTLFLQMNSLRAEDTAIYYCARDLYSSGGTDIWGQGTMVTVSS | 520 | ARDLYSSGGTDI | COVD21_mo6_K_P1C6-p1389 | 521 | EIVLTQSPGTLSLSPGERATLSCRASQSIGSSYLAWYQQKPGLAPRLLIYGASRRATGIPDKFSGSGSGADFTLTISRLEPEDFAVYYCQQYGSSPGTFGQGTKVEIK | 522 | QQYGSSPGT | KAPPA |
| 6.2M | COVD21_mo6_HC_P1D12-p1369 | 523 | EVQLVESGGGLIQPGGSLRVSCAASGVTVSSNYMTWVRQGPGKGLEWVSVIYPGGNTFYADSVKGRFTISRDTSKNTLSLQMNSLRVEDTAVYYCARDLGERGMDVWGHGTTVTV | 524 | ARDLGERGMDV | COVD21_mo6_K_P1D12-p1389 | 525 | DIQMTQSPSSVSASVGDRVTITCRASQGFGNWLAWYQQKPGKAPKLLIYAASNLQSGVPSRFSGSGSGTDFTLTISSLQAEDFATYFCQQANSFPSFGGGTKVEIK | 526 | QQANSFPS | KAPPA |
| 6.2M | COVD21_mo6_HC_P1D1-p1369 | 527 | QVQLVESGGGVVQPGRSLRLSCAASGFTFNNYGMHWVRQAPGKGLEWVAVIWYDGRSKHYADSVRGRFTISRDNSKNALFLQMNTLRAEDTAMYYCARDEGSLTTTFDSWGQGTLVTVSS | 528 | ARDEGSLTTTFDS | COVD21_mo6_K_P1D1-p1389 | 529 | DIQMTQSPSSLSASVGDRVTITCRASQSISSHLNWFQQKPGKAPKLLIYAASSLQTGVPSRFSGSGSGTDFTLTITSLQPEDFATYYCQQSYATPPWTFGQGTKVEI | 530 | QQSYATPPWT | KAPPA |
| 6.2M | COVD21_mo6_HC_P1D2-p1369 | 531 | EVQLLESGGGLVQPGGSLRLSCAASGFTFSSYVMSWVRQAPGKGLEWVSEISGSGDITDYADSVKGRFTISRDNSKKTLYLQMKSLRAEDTAVYYCARDSQLIDMVVVLDYWGQGTLVTVSS | 532 | ARDSQLIDMVVVLDY | COVD21_mo6_K_P1D2-p1389 | 533 | DIQMTQSPSSLSASVGDRVTITCRTSQTISNYLNWFQQKPGKAPKLLIYXVSSLRSGVPSRFSGSGSGTDFTLTISSLQPEDFATYYCQQTYTTPPTFGGGTKV | 534 | QQYYTTPPT | KAPPA |
| 6.2M | COVD21_mo6_HC_P1D4-p1369 | 535 | QVQLVESGGGVVQPGRSLRLSCAATGFTFSNFGMHWVRQAPGKGLEWVAVISYHGTNKDYADSVKGRFTISRDNSKNTLYLQLNSLRFDDTAVYYCARALDGDYSEYFQHWGQGTLVTVSS | 536 | ARALDGDYSEYFQH | COVD21_mo6_K_P1D4-p1389 | 537 | DVVMTQSPLSLPVTLGQPASISCTSSQSLLFSDGNTYLTWFQQRPGQSPRRLIYKVSNRDSGVPDRFSGSGSGTDFTLKISRVEAEDVGVYYCMQSTHWPQTFGQGTKVEIK | 538 | MQSTHWPQT | KAPPA |
| 6.2M | COVD21_mo6_HC_P1D6-p1369 | 539 | EVQLVESGGGLVQPDRSLRLSCAASGFTFDDYAMHWVRQAPGKGLEWVSGISRNSGIKVYADSVKGRFTISRDNAKNSLFLQMNSLRAEDTALYYCVKEIGLELPVDVFDFWGQGTMVTVSS | 54 | VKEIGLELPVDVFDF | COVD21_mo6_K_P1D6-p1389 | 541 | DIQMTQSPSSLSASVGDRVTLTCRASQSISRYLNWFQQKAGKAPKLLIYAASSLQTGVPSRFSGSGSGTDFTLTISSLQLEDFATYYCQQSYSTPVTFGQGTRLEIK | 542 | QQSYSTPVT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 6.2M | COVD21_mo6_HC_P1E12-p1369 | 543 | EVQLVESGGGLVQPGGSLRLSCAASGFTFSTYDMHWVRQATGKGLEWVSAIGTSGDTYYPDSVKGRFTISRENAKNSLFLQMNGLRAGDTAIYYCARGNWNPPSYYYMDVWGKGTTVTVS | 544 | ARGNWNPPSYYYMDV | COVD21_mo6_K_P1E12-p1389 | 545 | DIQMTQSPSSLSASVGDRVTISCRASQSINTYLNWYQQRPGKAPKLLIYASSSLQSGVPSRFSGSGSGTDFTLTISSLQPEDFATYYCQQSYSTPPWTFSQGTKVEIK | 546 | QQSYSTPPWT | KAPPA |
| 6.2M | COVD21_mo6_HC_P1E2-p1369 | 547 | QVQLVESGGGVVQPGRSLRLSCVASGFSFSKYGMHWVRQAPGKGLEWVAVVSYDGSNKYYADSVKGRIAVSRDNSKNTLFLQMNSLKAEDTAVYYCAKGGLYGSGTYYENFDYWGQGTRVTVSS | 548 | AKGGLYGSGTYYENFDY | COVD21_mo6_K_P1E2-p1389 | 549 | DIQMTQSPSSLSASVGDRVTIICQASQDITYYLNWFQQKPGKPPKLLIHDASNLEAGVPSRFSGGGSGTDFTFTISSLQPEDFATYYCQQYEHLPYTFGQGTRLEIK | 550 | QQYEHLPYT | KAPPA |
| 6.2M | COVD21_mo6_HC_P1F2-p1369 | 551 | QVQLVESGGGVVQPGRSLRLSCAASGLAFSIYGMHWVRQAPGKGLEWVAIVAQDGSKKYYADSVKGRFTISRDNSKNTLYLEMNSLRTEDTAVYYCVKEGRPSDTVVVVAFDYWGQGSLVTVSS | 552 | VKEGRPSDTVVVVAFDY | COVD21_mo6_K_P1F2-p1389 | 553 | DIQMTQSPSSLSASVGDRVTITCRASQSNYLNWYQQKPGKAPKVIIYAASSLQSGVPSRFSGSGSGTDFTLTISSLQPEDFATYYCQQSHSIPRTFGQGTKVEIK | 554 | QQSHSIPRT | KAPPA |
| 6.2M | COVD21_mo6_HC_P1F9-p1369 | 555 | QVQLQESGPGLVKPSETLSLTCTVSGGSVSSGTFYWSWIRQPPGKGLEWIGYIHYSGSTNYNPSLKSRVTISVDTSKNQFSLRLSSVTAADTAVYYCARESFYYDRSGYYGSDAFDIWGQGTMVTVSS | 556 | ARESFYYDRSGYYGSDAFDI | COVD21_mo6_K_P1F9-p1389 | 557 | DIQMTQSPSTLSSSVGDRVTITCRASQNISRWLAWYQQKPGKAPKLLIYKASTLESGVPSRFSGSGSGTKFTLTISSLQPDDFATYYCQQYNSYLYTFGQGTKLEMK | 558 | QQYNSYLYT | KAPPA |
| 6.2M | COVD21_mo6_HC_P1G12-p1369 | 559 | EVQLVESGGGLIHPGGSLRLSCAASDIIVSSNYMSWVRQAPGKGLEWVSVIYPGGSAFYGDSVKGRFTVSRDNSKNTLYLQMNSLSAEDTAVYYCARDLVVNGMDVWGQGTTVIVS | 560 | ARDLVVNGMDV | COVD21_mo6_K_P1G12-p1389 | 561 | DIQLTQSPSFLSASVGDRVTITCRASQSNYLAWYQQKPGKAPKLLIYAASTLQSGVPSRFSGSGSGTEFTLTISGLQPEDFATYYCQLLNSDPYTFGQGTKLEI | 562 | QLLNSDPYT | KAPPA |
| 6.2M | COVD21_mo6_HC_P1G5-p1369 | 563 | QVQLQESGPGLVKPSQTLSLTCTVSGGSISSGGYYWNWIRQHPGRGLEWIGYIFYSGSTYYNASLRSRVTISIDTSKNQFSLKLKSVTAADTAVYYCARDQGYSSSWDAFDIWGQGTMVTVSS | 564 | ARDQGYSSSWDAFDI | COVD21_mo6_K_P1G5-p1389 | 565 | EIVLTQSPGTLSLSPGERATLSCRASQSISSSYVAWYQQKTGQAPRLLIYGASSRATGIPDRFSGSGSGTEFTLTISRLEPEDFAVYYCQQHGSSLTFGGGTKVEIK | 566 | QQHGSSLT | KAPPA |
| 6.2M | COVD21_mo6_HC_P1H11-p1369 | 567 | QVQLVQSGAEVKKPGASVKVSCKASGYTFTSYGINWVRQAPGQGLEWMGWISAFNGDTNYAQKVQGRVTMTTDTSTNTVYMELRSLRSDDTAVYYCARDEYYYESGASSADIGHIWGQGTVVT | 568 | ARDEYYYESGASSADIGHI | COVD21_mo6_K_P1H11-p1389 | 569 | DIQMTQSPSSLSASVGDRVTITCRASQGIRNHLGWFQQKPGEAPKRLIYAASSLQTGVPSRFSGSGSGTQFTLTIASLQPEDFATYYCLHHDDFPPRFTFGPGTKVN | 570 | LHHDDFPPRFT | KAPPA |
| 6.2M | COVD21_mo6_HC_P1H3-p1369 | 571 | EVQLVESGGGLVKPGGSLRLSCVASGFTFRNAWMNWVRQAPGKGLEWVGRIKANSDGGTIDYAEPVQGRFTISREDSRNSLYLQMNSLKTEDTAVYYCTTGPQYDDFGHSYIVDSWGPGTLVTVSS | 572 | TTGPQYDDFGHSYIVDS | COVD21_mo6_K_P1H3-p1389 | 573 | DIVMTQSPLSLPVTLGEPASISCRSSQSLLHSNGFHFLEWYLQKPGQSPQLLIYVGSNRASGVPDRFSGSGSGTDFTLKISRVEAEDVGVYYCMQTLQTPLTFGGGTKVEIK | 574 | MQTLQTPLT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COVD21_mo6_HC_P1H7-p1369 | 575 | EVQLVESGGGLVKPGGSLRLSCAASGFTFSNAWMSWVRQAPGRGLEWVGRIKSKTDGGTTDYAAPVKGRFTISRDDSKNTLYLQMNSLK1EDTAVYYCTTDDPGSYYYGMDVWGQGTTVTVS | 576 | TTDDPGSYYYGMDV | COVD21_mo6_K_P1H7-p1389 | 577 | DIQMTQSPSSLSASVGDRVTITCQASQDISNYLNWYQQKPGKVPKLLIYDASNLEAGVPSRFSGSGSGKDFTFTISSLQPEDIATYYCQQYDSFPITFGPGTKVD | 578 | QQYDSFPIT | KAPPA |
| 6.2M | COVD21_mo6_HC_P1H8-p1369 | 579 | EVQLVESGGGLVQPGGSLRLSCAASGFTLSSHDMHWVRQVPGKRLEWVSAIGPSGDTYYPDSVKGRFTISRENAKNSLYLQMNSLRAGDTAVYYCARGNYFDSSGFRNYYYGMDVWGQGTTVTV | 580 | ARGNYFDSSGFRNYYGMDV | COVD21_mo6_K_P1H8-p1389 | 581 | EIVMTQSPATLSVSPGERATLSCRASQSVSSNLAWYQQKPGQAPRVLIYGASTRATGIPARFSGSGSGTEFTLTISSLQSEDFAVYYCQQYHNWPPLTFGGGTKVEI | 582 | QQYHNWPPLT | KAPPA |
| 6.2M | COVD21_mo6_HC_P2A11-p1369 | 583 | QVQLVESGGGVVQPGRSLRLSCVASGFSFSNYGMHWVRQAPGKGLEWVAAIWYDGVDKYRDSVKGRFTISRDNSKNTLYLQMNSLRVEDTAVYYCARVFGNWDDFDYWGQGTLVTVSS | 584 | ARVFGNWDDFDY | COVD21_mo6_K_P2A11-p1389 | 585 | DIQMTQSPSSLSASVGDRATITCRASQGITNDLGWYQQKPGKAPKRLIYGASSLQSGVPSRFSGSGSGTEFTLTISSLQPEDFATYYCLQHNSYPWTFGQGTKVEIK | 586 | LQHNSYPWT | KAPPA |
| 6.2M | COVD21_mo6_HC_P2A3-p1369 | 587 | EVQLVESGGGLVQPGRSLRLSCAASGFTLDDFAMHWVRQAPGKGLEWVSGISWNSGTIDYADSVKGRFTISRDNAKNSLYLQMNSLRPEDTAFYYCAKVLNRNSFFYGSFDYWGQGTLVTVSS | 588 | AKVLNRNSFFYGSFDY | COVD21_mo6_K_P2A3-p1389 | 589 | EIVMTQSPATLSVSPGESVTLSCRASQSVSSNLAWYQQKPGQAPRLLIYGASTRATGVPARFSGSGSGTEFTLTISSLQSEDFAVYYCQHYNNWPPGITFGQGTRLE | 590 | QHYNNWPPGIT | KAPPA |
| 6.2M | COVD21_mo6_HC_P2A5-p1369 | 591 | QVQLVESGGGVVQPGRSLRLSCAASGFTFSRYGMHWVRQAPGKGLEWVAVSSYDGSNEYYANSVKGRFTISRDNSKNTLYLQMNSLRAEDTAVYYCAKTGASYCGGDCPFHFDYWGQGTLVIVSS | 592 | AKTGASYCGGDCPFHFDY | COVD21_mo6_K_P2A5-p1389 | 593 | DIQMTQSPSSLSASVGDRVTITCQASQDINNYLNWYQQKPGKAPKLLIYDASDLETGVPSRFSGGGSGTDFTFTISSLQPEDIATYYCQHYNNLPITFGQGTRLEIK | 594 | QHYNNLPIT | KAPPA |
| 6.2M | COVD21_mo6_HC_P2A6-p1369 | 595 | EVQLVESGGGLIQPGGSLRLSCAASGFTFSTSDMHWVRQVIGKGLEWVSVIGSAGDTYYPDSVKGRFTISRENARNSLYLQMNSLRAEDTAVYYCARGRQQLIPDLITSRYNYYYYMDLWGKGTTVIVSS | 596 | ARGRQQLIPDLITSRYNYYYY | COVD21_mo6_K_P2A6-p1389 | 597 | DIQMTQSPSSLSASVGDRVTITCRASQSIGSYLNWYQQKPGKAPKLLIYAASSLQSGVPSRFSGSGSGTDFTLTISSLQPEDFATYYCQQSYSTLSYTFGQGTKLDIK | 598 | QQSYSTLSYT | KAPPA |
| 6.2M | COVD21_mo6_HC_P2B12-p1369 | 599 | EVQLVESGGGLIKPGGSLRLSCAASGFSFSDAWMTWVRQAPGKGLEWIGRIKSKTDGGTTDYAAPVKGRFTISRDDSKNTLYLQMKSLKVYYCATAADIVVVVAPDSPFDCWGQGTLVTVSS | 600 | ATAADIVVVVAPDSPFDC | COVD21_mo6_K_P2B12-p1389 | 601 | DIQMTQSPSSLSASVGDRVTITCRASQSISYYLNWYQQKPGKAPKLLIYAASSLQSGVPSRFSGSGSGTDFTLTITSLQPEDFATYYCQQSYSTLLTFGGGTKVEIK | 602 | QQSYSTLLT | KAPPA |
| 6.2M | COVD21_mo6_HC_P2B3-p1369 | 603 | EVQLVESGGGLVKPGGSLRLSCAASGFTFSSYSMNWVRQAPGKGLAWVSSISSSNNIIYYADKGRFTISRDDAKDSLYLHMKSLRADDTAVYFCARVPSWAPYQLLPGPFDYWGQGILVTV | 604 | ARVPSWA | COVD21_mo6_K_P2B9-p1389 | 605 | DIQMTQSPSSLSASVGDRVTITCQASQAIASYLSWYQHKPGRAPKLLIYDASNLEIGVPSRFSGSGSGTDFTFTISSLQSEDNATYYCQQYESLPGTFGGGTKVEIK | 606 | QQYESLPGT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 6.2M | COVD21_mo6_HC_P2B4-p1369 | 607 | EVQLVESGGGLVKPGGSLRLSCAASGFTFSSAWMSWVRQAPGKGLEWVGRIKTKTDGGTKDYAAPVKGRFTISRDDSKNTLYLQMNSLKIEDTAVYYCTTTNDYGDYSPAYWGQGTLVTVSS | 608 | TTTNDYGDYSPAY | COVD21_mo6_K_P2B4-p1389 | 609 | DIVMTQSPDSLAVSLGERATINCKSSQSILYVSNNKNYLAWYQQKPGQPPKLLIYWASSGVPDRFSGSGSGTDFTLTIGSLQAEDVAVYYCQQYYSPPPTFGQGTKVEI | 610 | QQYYSPPPT | KAPPA |
| 6.2M | COVD21_mo6_HC_P2B5-p1369 | 611 | QVQLVESGGGVVQPGRTLRLSCAASGFIFSDYGMHWVRQAPGKGLEWVAVIWYDGSNKYYADSVKGRFTISRDNSKNTLSLQMSSLRAEDTAVYYCARLATIPYFYYMDVWGKGTTVTVSS | 612 | ARLATIPYFYYMDV | COVD21_mo6_K_P2B5-p1389 | 613 | EIVMTQSPATLSVSPGERATLSCRASQSVSNKLAWYQQKPGQAPRLLIYGASTRATDIPARFSGSGSGTEFTLTISSLQSEDFAVYYCQQYSNWPPLTFGGGTKVEI | 614 | QQYSNWPPLT | KAPPA |
| 6.2M | COVD21_mo6_HC_P2B6-p1369 | 615 | QVQLVQSGAEVKKPGSSVKVSCKASGDTFSSHAINWVRQAPGQGLEWMGRSIPMLGVTTSAQKFKGRVTITADHSTSTVFMDLSSLRSDDTAIYYCARGVVGATPGSFDLWGQGTMVTVSS | 616 | ARGVVGATPGSFDL | COVD21_mo6_K_P2B6-p1389 | 617 | DIQMTQSPSSLSASVGDRVTITCRASQSISRYLNWYQQRPGRAPELLIYSASSLQSGVPSRFSASGSGTDFTLTISSLQPEDFATYYCQQSYETPPITFGQGTRLEI | 618 | QQSYETPPIT | KAPPA |
| 6.2M | COVD21_mo6_HC_P2C10-p1369 | 619 | QVQLVESGGGVVQPGRSLRLSCAASRFTFSSYGMHWVRQAPGKGLEWVAVIWHDGSNKYYADSVKGRFTISRDNSKNTVYLQMNSLRVEDTAVYYCARDESIMVTANEIDYWGQGTLVTVSS | 620 | ARDESIMVTANEIDY | COVD21_mo6_K_P2C10-p1389 | 621 | DIQMTQSPVSLSASVGDRVTITCRASQTIISHLNWYQQKPGKAPNLLIYAASSLQSGVPSRFSGSGSGTDFTLTISSLQPEDFATYYCQQSYSTPPWTFGQGTKVEIK | 622 | QQSYSTPPWT | KAPPA |
| 6.2M | COVD21_mo6_HC_P2C11-p1369 | 623 | QVQLVQSGAEVKKPGASVKVSCKASGYTFTNHYMHWVRQAPGQGLEWMGIINPGGGSTSYAQKFQGRVTMTSDTSTSTVYMELSSLRSEDTAVYYCAKDRGIIVSRDAFDIWGQGTMVTVSS | 624 | AKDRGIIVSRDAFDI | COVD21_mo6_K_P2C11-p1389 | 625 | DIQMTQSPVSLSASVGDRVTITCRASQSIGNWLAWYQQKPGKAPNLLIYKASSLESGVPSRFSGSGSGTEFTLTISSLQPDDFATYYCQQYNNYSWTFGQGTKVEIK | 626 | QQYNNYSWT | KAPPA |
| 6.2M | COVD21_mo6_HC_P2C9-p1369 | 627 | QVQLVESGGGVVQPGRSLRLSCAASGFTFSDYAMHWVRQAPGKGLEWVAVIWDDGRTKHYADSVKGRFTISRDKAKNTLYLQMNSLRAEDTAIYYCARDWGTLTTLFDYWGQGALVTVSS | 628 | ARDWGTLTTLFDY | COVD21_mo6_K_P2C9-p1389 | 629 | DIQMTQSPSSLSASVGDRVTITCRASQTIISHLNWYQQKPGKAPNLLIYAASSLQSGVPSRFSGSGSGTDFTLTISSLQPEDFATYYCQQSYSTPPWTFGQGTKVEIK | 630 | QQSYSTPPWT | KAPPA |
| 6.2M | COVD21_mo6_HC_P2D12-p1369 | 631 | EVQLVESGGGLVQPGGSLRLSCAASGFIFRSFWMYWVRQAPGKGLVWVSRISSDGSRTAYADSVKGRFTISRDNTKDTLYLQMNSLRAEDTAVYYCARVPRDYYDRTGNHHVDEYFQHWGQGTLVSVSS | 632 | ARVPRDYYDRTGNHHVDEYFQ | COVD21_mo6_K_P2D12-p1389 | 633 | EIVLTQSPGTLSLSPGERATLFCRASQSVTSSDLAWYQQKPGQAPRLLISGASSRATGIPDRFIGSGSGTDFTLTISGLAPEDFAVYYCQQYASSPYTFGQGTKLEI | 634 | QQYASSPYT | KAPPA |
| 6.2M | COVD21_mo6_HC_P2D3-p1369 | 635 | QVQLVQSGAAVKKPGASVKVSCKASGYTFTTYYMHWVRQAPGQGLEWMGIINPSAGSTTYAQRFQGRVTMTTDTSTSTVYMELSSLRSEDTAVYYCARGALIPMVGAPFDYWGQGTLVTVSS | 636 | ARGALIPMVGAPFDY | COVD21_mo6_K_P2D3-p1389 | 637 | DIQMTQSPSTLSASVGDRVTITCRASQSIGTGLAWYQQKPGTAPKVLIYKASTLESGVPSRFSGSGSGTEFTLTISSLQPDDFATYYCQYYSSYSPGYTFGQGTTLEI | 638 | QYYSSYSPGYT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COVD21_mo6_HC_P2D4-p1369 | 639 | QVQLVQSGAEVKKPGSSVKVSCKASGGTFSSYAISWVRQAPGQGLEWMGRSIPMLGVTTSAQKFKGRVTITADHSTSTVFMDLSSLRSDDTAIYYCARGVVGATPGSFDLWGQGTMVTVSS | 640 | ARGVVGATPGSFDL | COVD21_mo6_K_P2D4-p1389 | 641 | EIVLTQSPATLSLSPGERATLSCRASQSVSNYLAWYQQKPGAPRLLIYDASNRATGIPSGSGSGTDFTLTISSLEPEDFAVYYCQQRITFGQGTRLEIK | 642 | QQRIT | KAPPA |
| 6.2M | COVD21_mo6_HC_P2D9-p1369 | 643 | QVQLVESGGGVVHPARSLRLSCAASGFTFSSYGMHWVRQTPGKGLEWVAVISYDGSYKDYADSVKGRFTISRDNSKNTLYLQLNSLRAEDTAVYYCARDYGPMVTYHDYWGQGTLVTVSS | 644 | ARDYGPMVTYHDY | COVD21_mo6_K_P2D9-p1389 | 645 | DIQMTQSPSSLSASVGDRVTITCRASQSISSYLNWYQQKPGKAPKLLFYTASSLQSGVPSRFSGSGSGTDFTLTISSLQPEDFATYYCQQSYSTPPWTFGQGTKVEIK | 646 | QQSYSTPPWT | KAPPA |
| 6.2M | COVD21_mo6_HC_P2E12-p1369 | 647 | EVQLLESGGDLVQPGGSLRLSCEASGFTFSIYAMSWVRQVPGTGLEWVSGFSGNTGDTHYADSVKGRFTISRDTSSNTLYLQMNSLRAGDTAIYYCAKHAMGGWYGFGAFDIWGQGTTVTVSS | 648 | AKHAMGGWYGFGAFDI | COVD21_mo6_K_P2E12-p1389 | 649 | DIQLTQSPSFLSASVGDRVTITCRASQGIDSYLAWYQQTPGKAPKLLIYAASTLQSGVPSRFSGSGSGTDFTLTISSLQPEDFATYYCQRLNGYPWTFGQGTKVEIK | 650 | QRLNGYPWT | KAPPA |
| 6.2M | COVD21_mo6_HC_P2E5-p1369 | 651 | QVQLVQSGAEVKKPGSSVKVSCKASGGTFYAISWVRQAPGQGLEWMGGIIPIFGTANYAQKFQGRVTITADESTSTAYMELSSLRSEDTAVYYCARDLQNRGGMDVWGQGTTVTVSS | 652 | ARDLQNRGGMDV | COVD21_mo6_K_P2E5-p1389 | 653 | DIQMTQSPSSLSASVGDRVTITCQASHDISTYLNWYQHKPGKAPKVLIYDASNLQTGVPSRFSGSGSGTHFTFTISSLQPEDVATYYCHQYDNLPPTFGGGTKVEL | 654 | HQYDNLPPT | KAPPA |
| 6.2M | COVD21_mo6_HC_P2E6-p1369 | 655 | EVQLVESGGGLIQPGGSLRLSCAASGFTVSSNYMSWVRQAPGKGLEWVSVIYSGGSTYYADSVKGRFTISRDNSKNTLYLQMNSLRAEDTAIYYCARDVLERGGMDVWGQGTTVIVSS | 656 | ARDVLERGGMDV | COVD21_mo6_K_P2E6-p1389 | 657 | EIVLTQSPGTLSLSPGERATLSCRASQSVGSSFLAWYQQRPGQAPRLLIYGASSRATGIPDRFSGSGFGTDFTLTISRLEPEDSAVYYCQQFGSSPFTFGPGTRVEIK | 658 | QQFGSSPFT | KAPPA |
| 6.2M | COVD21_mo6_HC_P2F1-p1369 | 659 | EVQLVESGGGLVQPGRSLRLSCVVSGFTLENYAMHWVRQAPGKGLEWVSGISWNSGTKGYADSVKGRFTISRDNAKNSLYLQMNSLRAEDTALYYCAKDNAPKNDYDFWTDNFGKHYYYGMDVWGQGTTVTVS | 660 | AKDNAPKNDYDFWTDNFGKHYYYGMDV | COVD21_mo6_K_P2F1-p1389 | 661 | EIVLTQSPVSLSLSPGERATLSCRASQSVGSYLAWYQHKPGQAPRLLIYDALNRATGIPARFSGSGSGTDFTLTISSLEPEDFAVYYCQQRSNWPQLTFGGGTKVEIK | 662 | QQRSNWPQLT | KAPPA |
| 6.2M | COVD21_mo6_HC_P2F2-p1369 | 663 | EVQLVESGGGLVQPGGSLRLSCAASGFSFSTYWMSWVRQAPGKGLEWVADIKQDGSEKYFVDSVKGRFTISRDNAKNSLYLHLNSLRAEDTAVYYCAREMAGSGNYYWFGYGMDVVVGQGTTVTVSS | 664 | AREMAGSGNYYWFGYGMDV | COVD21_mo6_K_P2F2-p1389 | 665 | DIQMTQSPSSVSASVGDRVTITCRASQGISSWLAWYQQKPGKAPKLLIYAASSLQSGVPSRFSGSESGTDFTLTISSLQPEDFATYYCQQANSFPLTFGGGTKVEIK | 666 | QQANSFPLT | KAPPA |
| 6.2M | COVD21_mo6_HC_P2F9-p1369 | 667 | EVQLVESGGGLVQPGGSLRLSCAASGFTFSSYDMHWVRQVPGKGLEWVSGIGTAGDTYYPGSVKGRFTISREDAKHSLYLQLNSLRDGDTAVYYCARGDHRGSFHTFKTYYYYYMDVWGKGTTVTVSS | 668 | ARGDHRGSFHTFKTYYYYYMDV | COVD21_mo6_K_P2F9-p1389 | 669 | DIQMTQSPSSLSASVGDRVTITCRASQSISSYLNWYQLKPGKAPKLLIYAASTLHSGVPSRFSGSGSGTEFTLTISSLQPEDFATYYCQQSYSNPPENAFGQGTKLEIE | 670 | QQSYSNPPENA | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 6.2M | COVD21_mo6_HC_P2G12-p1369 | 671 | QVQLVQSGAAVKXXGASVKVSCKAFGYTFTSYDIIWVRQATGQGLEWMGWMSPNNSNTGYAQKFQGRVTMTRDTSINTAYMELTSLRSEDTAVYYCARFGYYYVDSGPNRARYTGLDVVVGQGTTVTVSS | 672 | ARFGYYYVDSGPNRARYTGLDV | COVD21_mo6_K_P2G12-p1389 | 673 | EIVLTQSPGTLSLSPGERVTLSCRASQSVGANYLAWYQQKPGQAPRLLIYGTYNRATGIPDRFSGSGSGTDFTLTISRLEPEDFAVYYCQQYNRSPITFGQGTRLEI | 674 | QQYNRSPIT | KAPPA |
| 6.2M | COVD21_mo6_HC_P2G1-p1369 | 675 | EVQLLESGGGLVQPGGSLRLSCAASGFTFSNYAMNWVRQAPGRGLEWVSAISSGGDRTYYADSVKGRFSISRDRSRNNLYLQTNSLRAEDTAIYYCVKGPYFDFWSGSYDDLPYYYHGMDVWGQG | 676 | VKGPYFDFWSGSYDDLPYYYHGMDV | COVD21_mo6_K_P2G1-p1389 | 678 | DIVMTQTPLSSPVTLGQTASISCRSSQSLVHSDGTTYLSWLQQRPGQPPRLLIYKISNRFSGVPDRFSGSGAGTDFTLKISRVEAEDVGVYYCMQGTEFPHTFGQGTKLEIK | 678 | MQGTEFPHT | KAPPA |
| 6.2M | COVD21_mo6_HC_P2H2-p1369 | 679 | QVQLVESGGGVVQPGRSLRLSCAASGFAFSTYGMHWVRQTPGKGLAWVAAISYDGRNTYYGDSVKGRFTITRDNSKNTLYLQLNSLRDEDTALYYCARDATMITLVRGIMGPPFDHWGQGSLVTVSS | 680 | ARDATMITLVRGIMGPPFDH | COVD21_mo6_K_P2H2-p1389 | 681 | DIQMTQSPSSLSASVGDRVTISCQASQGISNYLNQQKPGKAPKLLIHDASILETGVPSRFSGSGSGTDFTFTISSLQPEDIATYYCQQYDNFPPDFGPGTKVDI | 682 | QQYDNFPPD | KAPPA |
| 6.2M | COVD21_P1_HC_C5-p1369 | 683 | QVQLQESGPGLVKPSETLSLTCAVSGGSVSSGNYYWNWIRQPPGKGLEWIGYIYYSGSTNYNPSLKSRVTISVDTSKNQFSLKLNSVTAADTAVYHCARETYYYDSSGYYISDAFDIWGQGTMVTVSS | 684 | ARETYYYDSSGYYISDAFDI | COVD21_P2_K_C5-p1389 | 685 | DIQMTQSPSTLSASVGDRVTITCRASQSISSWLAWYQQKPGKAPKLLIYKASSLESGVPSRFSGSGSGTEFTLTISSLQPDDFATYYCQQYNSFSYTFGQGTKLEIK | 686 | QQYNSFSYT | KAPPA |
| 1.3M | COVD21_P3_HC_E6-p1369 | 687 | QVQLVESGGGVVQPGRSLRLSCAASGFTFSSYVMNWVRQAPGKGLAWVAVISFDGSNKYYADSVKGRFTVSRDNSKNTLYLQMNSLRAEDTALYYCARGPGWQWPELDYWGQGTLVTVSS | 688 | ARGPGWQWPELDY | COVD21_P3_L_E6-p1409 | 689 | QSVLTQPPSASGTPGQRVTISCSGSSSNIGSNTVNWYQQLPGTGPKLLIYSNNERPSGVPDRFSGSKSGTSASLAISGLQPEDEADYYCAAWDDSLNGPVFGTGTKVTVL | 690 | AAWDDSLNGPV | LAMBDA |
| 1.3M | COVD21_P3_HC_G3-p1369 | 691 | EVQLVESGGGLVQPGRSLRLSCAASGFTFDDYAMHWVRQAPGKGLEWVSGVTWNSGSIGYADSVKGRFIISRDNAKNSLYLQMNSLRAEDTALYYCAKGGEGFRNWNDGLDYFDYWGQGTLVTV | 692 | AKGGEGFRNWNDGLDYFDY | COVD21_P3_L_G3-p1409 | 693 | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVL | 694 | AAWDDSLNGYV | LAMBDA |
| 1.3M | COVD21_P2_HC_E2-p1369 | 695 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARGGYYYDSSGYEYYYYGMDVWGQGTTVTVSS | 696 | ARGGYYYDSSGYEYYYYGMDV | COVD21_P1_L_E2-p1409 | 697 | QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYWVFGGGTKLTVL | 698 | AAWDDSLSGYWV | LAMBDA |
| 1.3M | COVD21_P3_HC_D12-p1369 | 699 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREVKRVVAAPEYYFDYWGQGXLVTVSS | 700 | AREVKRVVAAPEYYFDY | COVD21_P3_L_D12-p1409 | 701 | QSVLTQPPSASGTPGQRVTISCSGISSNLGSNTVNWFQQLPGTAPKLLIYNSNRRPSGVPDRFSGSKSGTSASLAISGLQSEDEGDYYCAEWDDSLSTWVFGGGTHLTVL | 702 | AEWDDSLSTWV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P2_HC_B3-p1369 | 703 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGNRLLYCSSTSCYLDAVRQGYYYYYYMDVWGKGTTVTVSS | 704 | ARGNRLLYCSSTSCYLDAVRQGYYYYYYMDV | COVD21_P1_L_B3-p1409 | 705 | QSVLTQPPSASGTPGQRVTISCSGSSSNIGSNSVNWFQQLPGTAPKLLIYSNNQRPSGVPDRFSGSKSGASASLAISGLQSEDEADYYCASWDDSLNGPLFGGGTKL | 706 | ASWDDSLNGPL | LAMBDA |
| 1.3M | COVD21_P2_HC_D10-p1369 | 707 | EVQLVESGGGLVKPGGSLRLSCAASGFTFSDAWMSWVRQAPGKGLEWVGRLKSKTDGGTTDYAAPVKGRFTISRDDSKNTLSLQMNSLKTEDTAVYYCTTDQIYGDYLRMPVPFDYWGQGTLVTVSS | 708 | TTDQIYGDYLRMPVPFDY | COVD21_P1_L_D10-p1409 | 709 | QSVLTQPPSASGTPGQRVTISCSGSSSNIGSNYVYWYQQLPGTAPKLLIYRNNQRPSGVPDRFSGSKSGTSASLAISGLRSEDEADYYCATWDDSLSGPVFGGGTKL | 710 | ATWDDSLSGPV | LAMBDA |
| 1.3M | COVD21_P1_HC_D10-p1369 | 711 | QVQLVQSGAEVKKPGASVKVSCKASGYTFTGYYMHWVRQAPGQGLEWMGWINPISGGTNSAQKFQGRVTMTRDTSITTAYMELSSLRSDDTAVYHCAKSPYYYDSSGYLGGFDYWGQGTLVTVSS | 712 | AKSPYYYDSSGYLGGFDY | COVD21_P2_L_D10-p1409 | 713 | QSVLTQPASESGSPGQSITISCTGTSSDVGTYNLVSWYQQHPGKAPKLMIYEGSKRPSGVSNRFSGSKSGNTASLTISGLQAEDEADYYCCSYAASSTYVFGTGTK | 714 | CSYAASSTYV | LAMBDA |
| 1.3M | COVD21_P3_HC_A5-p1369 | 715 | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATEDYYDSSGSFDYWGQGTLVTVSS | 716 | ATEDYYDSSGSFDY | COVD21_P3_L_A5-p1409 | 717 | QSVLTQPRSVSGSPGQSVTISCTGTSSDVGGYNYVSWYQQHPGKAPKLMIYDVSKRPSGVPDRFSGSKSGNTASLTISGLQAEDEADYYCCSYAGSFWVFGGGTKLTVL | 718 | CSYAGSFWV | LAMBDA |
| 1.3M | COVD21_P1_HC_C7-p1369 | 719 | QVQLVQSGAEVKKPGASVKVSCKASGYTFTGYYMHWVRQAPGQGLEWMGWINPNSGGRNYTQKFQGRVTMTRDTSISTAYMELSRLRSDDTAVYYCARDLGYSYVQGYFDYWGXGTLVTVSS | 720 | ARDLGYSYVQGYFDY | COVD21_P2_L_C7-p1409 | 721 | QSALTQPASESGSPGQSITISCTGTSSDVGSYNLVSWYQQHPGKAPKLMIYEGSKRPSGVSNRFSGSKSGNTASLTISGLQAEDEADYYCCSYAGSNTWVFGGGTKLTVL | 722 | CSYAGSNTWV | LAMBDA |
| 1.3M | COVD21_P2_HC_B12-p1369 | 723 | QVQLVQSGAEVKKPGASVKVSCKASGYIFTGYYMHWVRQAPGQGLEWMGWINPNSGGTNYAQKFQGRVTMTRDTSISTVYMELSRLRSDDTAVYYCARDLGFSRLQFLFDYWGQGTLVTVSS | 724 | ARDLGFSRLQFLFDY | COVD21_P1_L_B12-p1409 | 725 | QSVLTQPASVSGSPGQSITISCTGTSSDVGSYNLVSWYQQHPGKAPKLMIYEVSKRPSGVSNRFSGSKSGNTASLTISGLQAEDEADYYCCSYAGSSIVVFGGGTKLTVL | 726 | CSYAGSSIVV | LAMBDA |
| 1.3M | COVD21_P3_HC_G7-p1369 | 727 | QVQLQESGPGLVKPSQTLSLTCTVSGGSISSGGYYWSWIRQHPGKGLEWIGYIYYSGSPYYNPSLKSRVTISIDTSKNQFSLKLSSVTAADTAVYYCARVHVVRGVANYPYFDYWGQGTLVTVSS | 728 | ARVHVVRGVANYPYFDY | COVD21_P3_L_G7-p1409 | 729 | QSXXTQPRSVSGSPGQSVTISCTGTSSDVGGYNCVSWYQQHPGKAPKLMIYDVSKRPSGVPDRFSGSKSGNTASLTISGLQAEDEADYYCCSYAGSYTPWVFGGGTKLTVL | 730 | CSYAGSYTPWV | LAMBDA |
| 1.3M | COVD21_P1_HC_E10-p1369 | 731 | QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCAREYFYDSSDYYFEYYFDYWGQGTLVTVSS | 732 | AREYFYDSSDYYFEYYFDY | COVD21_P2_L_E10-p1409 | 733 | QSVLTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTYVFGTGTKVTVL | 734 | CSYAGSYTYV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P1_HC_E4-p1369 | 735 | QVQLVQSGAEVKKPGASVKVSCKAXGYTFTRXHMQWVGQAPGQGLEWMGIINXSGGSTSYAQKFQGRVTMARDTSTSSVXMELSSLRXRTRPCITVLVGISTIVVVRPAVWTSGAKGPRSPXX | 736 | LVGISTIVVVRPAVWTS | COVD21_P2_L_E4-p1409 | 737 | QSVLTQPSSHSASSGASVRLTCMLSSGFSVGDFWIRWYQQKPGNPPRYLLYYHSDSNKGQGSGVPSRFSGSNDASANAGILRISGLQPEDEADYYCGTWHSNSRVFGGGTKLTVL | 738 | GHTWHSNSRV | LAMBDA |
| 1.3M | COVD21_P2_HC_A9-p1369 | 739 | QVQLQESGPGLVKPSQTLSLTCTVSGGSFSGYYWHWIRQHPGKGLEWIGYIYYSGSTYYNPSLKSRVTISVDTSKNQFSLKLSSVTAADTAVYYCARVATDYGDSFDYWGQGTLVTVSS | 740 | ARVATDYGDSFDY | COVD21_P1_L_A9-p1409 | 741 | QSVLTQEPSLTVSPGGTVTLTCASSTGAVTSGYYPSWFQQKPGQAPRALIYSTSNKHSWTPARFSGSLLGGKAALTLSGVQPEDEADYYCLLYYGGAWVFGGGTKLTVL | 742 | LLYYGGAWV | LAMBDA |
| 1.3M | COVD21_P2_HC_H2-p1369 | 743 | EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDSGGDIVVIPAVNGFDYWGQGTLVT | 744 | ARDSGGDIVVIPAVNGFDY | COVD21_P1_L_H2-p1409 | 745 | SYVLTQPPSVSVSPGQTARITCSGDALPNQYAYWYQQKPGQAPVLVIYKDSERPSGIPERFSGSSSGTTVTLTISGVQAEDEADYYCQSADSRGVFGGGTKLTVL | 746 | QSADSRGV | LAMBDA |
| 1.3M | COVD21_P2_HC_D9-p1369 | 747 | EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARAWAMRQTTLTPEWIDYWGQGTLVTVSS | 748 | ARAWAMRQTTLTPEWIDY | COVD21_P1_L_D9-p1409 | 749 | SYVLTQPPSVSVSPGQTARITCSGDALPKQYAYWYQQKPGQAPVLVIYKDSERPSGIPERFSGSSSGTTVTLTISGVQAEDEADYYCQSADSRKVVFGGGTKLTV | 75 | QSADSRKVV | LAMBDA |
| 1.3M | COVD21_P1_HC_C10-p1369 | 751 | EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARYYDILTGYYVDYYYMDVWGXGTTVTVSS | 752 | ARYYDILTGYYVDYYYMDV | COVD21_P2_L_C10-p1409 | 753 | SYVLTQPPSVSVSPGQTARITCSGDALPKQYAFWYQQKPGQAPVLVIYKDSERPSGIPERFSGSSSGTTVTLTISGVQAEDEADYYCQSADSSGTYVVFGGGTRLT | 754 | QSADSSGTYVV | LAMBDA |
| 1.3M | COVD21_P1_HC_F1-p1369 | 755 | EVQLVESGGGLVQPGGSLRLSCAASGFTFSSYWMSWVRQAPGKGLEWVTNIKLDGSEKYYVDSVKGRFTISRDNAKNSLYLQMNSLRAEDTAVYYCARLRWLRADFDYWGQGTLVTVSS | 756 | ARLRWLRADFDY | COVD21_P2_L_F1-p1409 | 757 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSGNVVFGGGTKLTVL | 758 | QSYDSGNVV | LAMBDA |
| 1.3M | COVD21_P1_HC_B6-p1369 | 759 | QVQLQESPGLVKPSETLSLTCTVSGGSISAYYWSWIRQPAGKGLEWIGRIYTSGSTIYNPSLKSRVTMSVDTSKNQFSLKLSSVTAADTAVYYCARDNGYVWGSYRPDAFDIWGQGTMVTVSS | 760 | ARDNGYVWGSYRPDAFDI | COVD21_P2_L_B6-p1409 | 761 | NFMLTQPHSVSESPGKTVTISCTGSSGSIASNYVQWYQQRPGSAPTTVIYEDNQRPSFVPDRISGSIDSSSNASLTISGLKTEDEADYYCQSYDSRNVVFGGGTRLTVL | 762 | QSYDSRNVV | LAMBDA |
| 1.3M | COVD21_P2_HC_D4-p1369 | 763 | QVQLQESGPGLVKPSETLSLTCTVSGGSISSYYWSWIRQPAGKGLEWIGRIYTSGSTNYNPSLESRVTMSVDTSKNQFSLKLSSVTAADTAVYYCARVVGYSSRGANYYMDVWGKGTTVTVSS | 764 | ARVVGYSSRGANYYMDV | COVD21_P1_L_D4-p1409 | 765 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSDSLFGGGTKLTVL | 766 | QSYDSSLSDSL | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 1.3M | COVD21_P3_HC_H8-p1369 | 767 | QVQLQESGPGLVKPSETLSLTCTVSGGSISSYYCMHWVRQAPGKGLEWVAVIWYDGNNKYYADSVKGRFTISRDNSKNTLYLQMNSLRAEDTAVYYCAREKDIVATDFDYWGQGTLVTVSS | 768 | AREKDIVATDFDY | COVD21_P3_L_H8-p1409 | 769 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGPYVFGTGTKVTVL | 770 | QSYDSSLSGPYV | LAMBDA |
| 1.3M | COVD21_P3_HC_C11-p1369 | 771 | QVQLVQSGAEVKKPGSSVKVSCKASGGTFSSYAISWVRQAPGQGLEWMGGIIPIFGTANYAQKFQGRVTITADKSTSTAYMELSSLRSEDTAVCYCARVGYYYDRSGFPRTEDYFDYWGQGTLVTVSS | 772 | ARVGYYYDRSGFPRTEDYFDY | COVD21_P3_L_C11-p1409 | 773 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVVFGGGTKLTVL | 774 | QSYDSSLSGVV | LAMBDA |
| 1.3M | COVD21_P3_HC_C4-p1369 | 775 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARSYDSSGLSYNWFDPWGQGTLVTVSS | 776 | ARSYDSSGLSYNWFDP | COVD21_P3_L_C4-p1409 | 777 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVVFGGGTKLTVL | 778 | QSYDSSLSGYVV | LAMBDA |
| 1.3M | COVD21_P1_HC_A12-p1369 | 779 | QVQLVESGGGLVKPGGSLRLSCAASGFTFSDYYMSWIRQAPGKGLEWVSSISSSGSTIYYADSVKGRFTISRDNAKTSLYLQMNSLRAEDTAVYYCARGKWLRGSFDYWGQGTLVTVSS | 780 | ARGKWLRGSFDY | COVD21_P2_L_A12-p1409 | 781 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVL | 782 | QSYDSSNHWV | LAMBDA |
| 1.3M | COVD21_P2_HC_F8-p1369 | 783 | EVQLLESGGGLVQPGGSLRLSCAASGFTFSSYAMSWVRQAPGKGLEWVSAISGSGGTTYYADSVKGRFTISRDNSKNTLYLQMNSLRAEDTAVYYCAKVPIHYCSNGVCYFDYWGQGTLVTVSS | 784 | AKVPIHYCSNGVCYFDY | COVD21_P1_L_F8-p1409 | 785 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNRWVFGGGTKLTVL | 786 | QSYDSS | LAMBDA |
| 1.3M | COVD21_P2_HC_G7-p1369 | 787 | QVQLVQSGAEVKKPGASVKVSCKASGYTFTGYYMHWVRQAPGQGLEWMGWINPNSGGTNYAQKFQGRVTMTRDTSISTAYMELSRLTSDDTAVYYCARGGQDELTGAFDIWGQGTMVTVS | 788 | ARGGQDELTGAFDI | COVD21_P1_L_G7-p1409 | 789 | SYVLTQPPSVSVAPGKTARITCGGNSIGSKSVHWYQQKPGQAPVLVIYYDGIPERFSGSNSGNTATLTISRVEAGDEADFHCQVWDSGWVFGGGTKLTVL | 790 | QVWDSGWV | LAMBDA |
| 1.3M | COVD21_P2_HC_A8-p1369 | 791 | EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAREAHDGALTDYGDYLNWFDPWGQGTLVTVSS | 792 | AREAHDGALTDYGDYLNWFDP | COVD21_P1_L_A8-p1409 | 793 | SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHLYWVFGGGTKLTVL | 794 | QVWDSSSDHLYW | LAMBDA |
| 1.3M | COVD21_P1_HC_A5-p1369 | 795 | EVQLVESGGGLVQPGRSLRLSCAASGFTFDDYAMHWVRQAPGKGLEWVSGISWNSGTIGYADSVKGRFTISRDNAKNSLHLHMRSLRAEDTALYYCAKDGRSGDQWPELYYFDYWGQGTLVTVSS | 796 | AKDGRSGDQWPELYYFDY | COVD21_P2_L_A5-p1409 | 797 | SYVLTQPPSVSVAPGKTARITCGGNDIGSNGVYWYQQKPGQAPVLVIYYDRPSGIPERFSGSNSGNTATLTISRVEAGDEADYYCQVWDSSSDHVVFGGGTKLTVL | 798 | QVWDSSSDHVV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 1.3M | COVD21_P1_HC_D3-p1369 | 799 | QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARSSVTGTPPFDYWGQGTLVTVSS | 800 | ARSSVTGTPPFDY | COVD21_P2_L_D3-p1409 | 801 | SYVLTQPPSVSVAPGKTARITCGGNNIGSKSVHWYQQKPGQAPVLVIYYDSDRPSGIPERFSGSNSGNTAILTISRVEAGDEADYYCQVWDSSSDHVVFGGGTKLTVL | 802 | QVWDSSSDHVV | LAMBDA |
| 1.3M | COVD21_P2_HC_G8-p1369 | 803 | QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARVPREGTPGFDPWGQGTLVTVSS | 804 | ARVPREGTPGFDP | COVD21_P1_L_G8-p1409 | 805 | SYVLTQPPSVSVAPGKTARITCGENNIGSKSVHWYQQKPGQAPVLVIYYDSDRPSGIPERFSGSNSGNTATLTINRVEAGDEADYYCQVVVDSSSDHVVFGGGTKLTVL | 806 | QVWDSSSDHVV | LAMBDA |
| 1.3M | COVD21_P1_HC_F11-p1369 | 807 | EVQLLESGGGLVQPGGSLRLSCAASGFTFSSYAMSWVRQAPGKGLEWVSGISDSGVSTYNADSVKGRFTISRDNSKNTLYLQMNSLRAEDTAVYYCAKVWSISLDAFDIWGQGTMVTVSS | 808 | AKVWSISLDAFDI | COVD21_P2_L_F11-p1409 | 809 | SYVLTQPPSVSVAPGKTARITCGGNNIGSKSVHWYQQKPGQAPVLVIYYDSDRPSGIPERFSGSNSGNTATLTISRVEAGDEADYYCQVWDSSSDLFGGGTKLTVL | 810 | QVWDSSSDL | LAMBDA |
| 1.3M | COVD21_P1_HC_D6-p1369 | 811 | EVQLVESGGGLVQPGRSLRLSCAASGFTFDDYAMHWVRQAPGKGLEWVSGISWNSVSIDYADSVKGRFTISRDNAKNSLYLQMNSLRAEDTALYYCAKDGAGTENWFDPWGQGTLVTVSS | 812 | AKDGAGTENWFDP | COVD21_P2_L_D6-p1409 | 813 | SYVLTQPPSVSVAPGKTARITCGGNNIGSKSVHWYQQKPGQAPLLVIYYDSDRPSGIPERFSGSNSGNTATLTISRVEAGDETDYYCQVWDSSSDPHVVFGGGTKLTV | 814 | QVWDSSSDPHVV | LAMBDA |
| 1.3M | COVD21_P1_HC_B5-p1369 | 815 | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDSPFSGLGASNDYWGQGTLVTVSS | 816 | ARDSPFSGLGASND | COVD21_P2_L_B5-p1409 | 817 | QSVLTQPPSASGSPGQSVTISCTGTSSDVGGYNYVSWYQQHPGKAPKLMIYEVSKRPSGVPDRFSGSKSGNTASLTVSGLQAEDEADYYCSSDAGSNNVVFGGGTKLTVL | 818 | SSDAGSNNVV | LAMBDA |
| 1.3M | COVD21_P3_HC_B5-p1369 | 819 | QVQLVQSGAEVKKPGASVKVSCMASGYTFTGYYMHWVRQAPGQGLEWMGWINPNSGGTNYAQKFQGRVTMTRDTSISTAYMELSRLRSDDTAVYYCARDSPFSALGASNDYWGQGTLVTVSS | 820 | ARDSPFSALGASND | COVD21_P3_L_B5-p1409 | 821 | QSALTQPPSASGSPGQSVTISCTGTSSDVGGYNYVSWYQQHPGKAPKLMIYEVSKRPSGVPDRFSGSKSGNTASLTVSGLQAEDEAEYYCSSDAGSNNVVFGGGTKLTVL | 822 | SSDAGSNNVV | LAMBDA |
| 1.3M | COVD21_P2_HC_C3-p1369 | 823 | EVQLVESGGGLVKPGGSLRLSCAASGFTFSTYNMNWVRQAPGKGLEWVSSITSSSSYIYYADSVKGRFTISRDNAENSLYLQMNSLRAEDTAVYYCARDRNRYDFWSGYYRLVGFDPWGQGTLVTVSS | 824 | ARDRNRYDFWSGYYRLVGFDP | COVD21_P1_L_C3-p1409 | 825 | QSVLTQPPSASGSPGQSVTISCTGTSSDVGGYKYVSWYQQHPGKAPKLMIYEVSKRPSGVPDRFSGSKSGNTASLTVSGLQAEDEADYYCSSYAGSNNHVFGGGTKLTVL | 826 | SSYAGSNNHV | LAMBDA |
| 1.3M | COVD21_P1_HC_D5-p1369 | 827 | QVQLQESGPGLVKPSQTLSLTCTVSGGSISSGGYYWGWIRQHPGKGLEWIGYIYYSGSTYYNPSLKSRVTISVDTSKNQFSLKLSSVTAADTAVYYCARGSYSNYNGGLDYWGQGTLVTVSS | 828 | ARGSYSNYNGGLD | COVD21_P2_L_D5-p1409 | 829 | QSVLTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL | 830 | SSYAGSNNWV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P3_HC_G10-p1369 | 831 | QVQLVESGGGVVQPGRSLRLSCAASGFTFTSYGMHWVRQAPGKGLEWVAVIWYDGSNKYYADSVKGRFTISRDNSKNTLYLQMNSLRAEDTAVYYCARDMMIRGVAWYYYMDVWGKGTTVTVSS | 832 | ARDMMIRGVAWYYMDV | COVD21_P3_L_G10-p1409 | 833 | QSVLTQPASVSGSPGQSITISCTGTSSDVGGYNYVSWYQQHPGKAPKLIIYNVSNRPSGVSNRFSGSKSGNTASLTISGLQAEDEADYYCSSYISSNTVFGGGTKLTVL | 834 | SSYISSNTV | LAMBDA |
| 1.3M | COVD21_P2_HC_F2-p1369 | 835 | EVQLVESGGGLVQPGRSLRLSCAASGFTFDDYAMHWVRQAPGKGLEWVSGTSWNSGTIGYADSVKGRFTISRDNAKNSLYLQMNSLRAEDTALYYCAKGRVVYAIDPDSVSPFDYWGQGTLVTVSS | 836 | AKGRVVYAIDPDSVSPFDY | COVD21_P1_L_F2-p1409 | 837 | QSVLTQPASVSGSPGQSITISCTGTSSGVGGYNFVSWYQQHPGKAPKLMIYDVSNRPSGVSNRFSGSKSGNTASLTISGLQAEDEADYHCSSYTSRSTLGVFGGGTKLTVL | 838 | SSYTSRSTLGV | LAMBDA |
| 1.3M | COVD21_P2_HC_G3-p1369 | 839 | EVQLVESGGGLVQPGRSLRLSCAASGFTFDDYAMHWVRQAPGKGLEWVSGISWNSGSIGYAHSVKGRFTISRDNAKNSLYLHMNSLRAEDTALYYCAKDMLGNYYYYAMVVWGQGTTVTVSS | 840 | AKDMLGNYYYYAMVV | COVD21_P1_L_G3-p1409 | 841 | QSALTQPASVSGSPGQSITISCTGTSSDVGGYNYVSWYQHHPGKAPKLMIYDVSNRPSGVSNRFSGSKSGNTASLTISGLQAEDEADYYCSSYTSSSTLEGVFGGGTKLTVL | 842 | SSYTSSSTLEGV | LAMBDA |
| 1.3M | COVD21_P1_HC_D7-p1369 | 843 | QVQLVQSGAEVKKPGASVKVSCKASGYTFTDYYLHWVRQAPGQGLEWMGWINPTSGGTKYAQKFQGRVTMTRDTSITTAYMEVNRLRSDDTAVYYCARDRPLWFGVEYGMDVVVGQGTTVTVSS | 844 | ARDRPLWFGVEYGMDV | COVD21_P2_L_D7-p1409 | 845 | QSVLTQPASVSGSPGQSITISCTGTNSDVGGYNYVSWYQQHPGKAPKLMIYDVGNRPSGVSNRFSGSKSGNTASLTISGLQAEDEADYYCSSYTSSSTLVFGGGTKLTVL | 846 | SSYTSSSTLV | LAMBDA |
| 1.3M | COVD21_P1_HC_F4-p1369 | 847 | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCASTGYYILTGYEFGAMDVWGQGTTVTVSS | 848 | ASTGYYILTGYEFGAMDV | COVD21_P2_L_F4-p1409 | 849 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTVFGTGTKVTVL | 850 | SSYTSSSTV | LAMBDA |
| 1.3M | COVD21_P1_HC_E2-p1369 | 851 | EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKPRKRGDYYGSGSYDYWGQGTLVTVSS | 852 | AKPRKRGDYYGSGSYDY | COVD21_P2_L_E2-p1409 | 853 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKLTVL | 854 | SSYTSSSTVV | LAMBDA |
| 1.3M | COVD21_P3_HC_C12-p1369 | 855 | QVQLVESGGGVVQPERSLRLSCAASGFTFSSYAMHWVRQAPGKGLEWVAVISYDGSNKYYADSVKGRFTISRDNSKNTLYLQMNSLRAEDTAVYYCARSKSYTSWGYYHMDVW | 856 | ARSKSYTSWGYYHMDV | COVD21_P3_L_C12-p1409 | 857 | QSVLTQPASVSGSPGQSITISCAGTSSDVGAYNYVSWYQQHPGKAPKLMIYDVSNRPSGVSNRFSGSKSGNTASLTISGLQAEDEADYYCSSYTSSSTWVFGGGTKLTVL | 858 | SSYTSSSTWV | LAMBDA |
| 1.3M | COVD21_P1_HC_C1-p1369 | 859 | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCATTEGQQLPHPPYYYYYYYMDVWGKGTTVTVSS | 860 | ATIEGQQLPHPPYYYYYYMDV | COVD21_P2_L_C1-p1409 | 861 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTYVFGTGTKVTVL | 862 | SSYTSSSTYV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P2_HC_F4-p1369 | 863 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARYGMGELLTLRSEYYFDYWGQGTLVTVSS | 864 | ARYGMGELLTLRSEYYFDY | COVD21_P1_L_F4-p1409 | 865 | QSVLTQPRSVSGSPGQSVTISCTGTSSDVGGYNYVSWYQQHPGKAPKLMIYDVSKRPSGVPDRFSGSKSGNTASLTISGLQAEDEADYYCYSYAGSYTFVFGGGTKLTVL | 866 | YSYAGSYTFV | LAMBDA |
| 1.3M | COVD21_P1_HC_E5-p1369 | 867 | QVQLVESGGGLVKPGGSLRLSCAASGFIFSDYCMSWIRRAPGKGLEWLSYISNSGTTRYYADSVKGRFTISRDNGRNSLYLQMDSLSAEDTAVYYCARRGDGSSSIYYYNYMDVWGKGTTVTVSS | 868 | ARRGDGSSSIYYYNYMDV | COVD21_P2_L_E5-p1409 | 869 | QSVLTQPPSASGTPGQRVTVSCSGSSSNIGSNTVNWYQQLPGTAPKLLIYSNNQRPSGVPDRFSGSKSGTSASLAISGLQSEDEADYFCAAWDDSLNGPVFGGGTKLTVX | 870 | AAWDDSLNGPV | LAMBDA |
| 1.3M | COVD21_P1_HC_F8-p1369 | 571 | QVQLVESGGGLVKPGGSLRLSCAASGFTFSDYCMSWIRQAPGKGLEWLSYISNSGTTRYYADSVKGRFTISRDNGRNSLYLQMNSLSAEDTAVYYCARRGDGSSSIYYYNYMDVWGKGTTVTVSS | 872 | ARRGDGSSSIYYYNYMDV | COVD21_P2_L_F8-p1409 | 873 | QSVLTQPPSASGTPGQRVTVSCSGSSSNIGSNTVNWYQQLPGTAPKLLIHSNNQRPSGVPDRFSGSKSGTSASLAISGLQSEDEADYYCAAWDDSLNGPVFGGGT | 874 | AAWDDSLNGPV | LAMBDA |
| 1.3M | COVD21_P1_HC_G5-p1369 | 875 | QVQLVESGGGLVKPGGSLRLSCAASGFTFSDYCMSWIRQAPGKGLEWLSYISNSGTTRYYADSVKGRFTISRDNGRNSLYLQMNSLSAEDTAVYYCARRGDGSSSIYYYNYMDVWGKGTTVTVSS | 876 | ARRGDGSSSIYYYNYMDV | COVD21_P2_L_G5-p1409 | 877 | QSVLTQPPSASGTPGQRVTVSCSGSSSNIGSNTINWYQQLPGTAPKLLIYSNNQRPSGVPDRFSGSKSGTSASLAISGLQSEDEANYYCAAWDDSLNGPVFGGGTKLTVL | 878 | AAWDDSLNGPV | LAMBDA |
| 1.3M | COVD21_P1_HC_A10-p1369 | 879 | EVQLVESGGGLIQPGGSLRLSCAASGFTVSSNYMSWVRQAPGKGLEWVSVIYSGGSTYYADSVKGRFTISRDNSKNTLYLQMNSLRAGDTAVYYCARDYGDFYFDYWGQGTLVTVSS | 880 | ARDYGDFYFDY | COVD21_P2_K_A10-p1389 | 881 | EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPRTFGQGTKLEIK | 882 | QQYGSSPRT | KAPPA |
| 1.3M | COVD21_P1_HC_A2-p1369 | 883 | EVQLVESGGGLIQPGGSLRLSCAASGFTVSSNYMTWVRQAPGKGLEWVSLIYSGGSTFYADSVKGRFTISRDSSKNTLYLQMNSLRAEDTAVYYCARGYGDYYFDYWGQGTLVTVSS | 884 | ARGYGDYYFDY | COVD21_P2_K_A2-p1389 | 885 | DIQLTQSPSFLSASVGDRVTITCRASQGISSYLAWYQQKPGKAPKLLIYAASTLQSGVPSRFSGSGSGTEFTLTISSLQPEDSATYYCQHLNGFGPGTKVDIK | 886 | QHLNG | KAPPA |
| 1.3M | COVD21_P1_HC_A3-p1369 | 887 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDLYSSGGTDIWGQGTMVTVSS | 888 | ARDLYSSGGTDI | COVD21_P2_K_A3-p1389 | 889 | EIVLTQSPVSLSLSPGERATLSCRASQSVSSSYLAWYQQKPGQAPRLLIYGASSRATGIPDRFSGSGSGTDFTLTISRLEPEDFAVYYCQQYGSSPGTFGQGTKVEIK | 890 | QQYGSSPGT | KAPPA |
| 1.3M | COVD21_P1_HC_A4-p1369 | 891 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDHSLGVRGDGYGMDVWGQGTTVTVSS | 892 | ARDHSLGVRGDGYGMDV | COVD21_P2_K_A4-p1389 | 893 | AIQLTQSPSSLSASVGDRVTITCRASQGISSALAWYQQKPGKAPKFLIYDASSLESGVPSRFSGSGSGTDFTLTISSLQPEDFATYYCQQFNNYPLTFGGGTKVEIK | 894 | QQFNNYPLT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P1_HC_B12-p1369 | 895 | EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDLSVFGMDVWGQGTTVTVSS | 896 | ARDLSVFGMDV | COVD21_P2_K_B12-p1389 | 897 | DIQLTQSPSFLSASVGDRVTVTCRASQGISSYLAWYQQKPGKAPKLLIYAASTLQSGVPSRFSGSGSGTEFTLTISSLQPEDFATXYCQQVNSYSHFGGGSKAEI | 898 | QQVNSYSH | KAPPA |
| 1.3M | COVD21_P1_HC_B1-p1369 | 899 | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSEDCSSTSCYLDYWGQGTLVTVSS | 900 | ARDSEDCSSTSCYLDY | COVD21_P2_K_B1-p1389 | 901 | DIVMTQSPXSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGPGTKVDIK | 902 | QQYYSTPFT | KAPPA |
| 1.3M | COVD21_P1_HC_B2-p1369 | 903 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKASGIYCSGGNCYSYYFDYWGQGTLVTVSS | 904 | AKASGIYCSGGNCYSYYFDY | COVD21_P2_K_B2-p1389 | 905 | DIQMTQSPSTLSASVGDRVTITCRASQSISSWLAWYQQKPGKAPKLLIYKASSLESGVPSRFSGSGSGTEFTLTISSLQPDDFATYYCQQYNSYSTFGQGTKVEIK | 906 | QQYNSYST | KAPPA |
| 1.3M | COVD21_P1_HC_B7-p1369 | 907 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 908 | AKEGRPSDIVVVVAFDY | COVD21_P2_K_B7-p1389 | 909 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 910 | OOSYSTPRT | KAPPA |
| 1.3M | COVD21_P1_HC_B9-p1369 | 911 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 912 | AKEGRPSDIVVVVAFDY | COVD21_P2_K_B9-p1389 | 913 | DIQMTQSPXSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 914 | QQSYSTPRT | KAPPA |
| 1.3M | COVD21_P1_HC_C4-p1369 | 915 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKAGGPYCSGGSCYSSYFDYWGQGTLVTVSS | 916 | AKAGGPYCSGGSCYSSYFDY | COVD21_P2_K_C4-p1389 | 917 | EIVLTQSPXXLSLSPGERATLSCRASQSVSSRNLAWYQQKPGQAPRLLIDGASSRATGIPDRFSGSGSGTDFTLTISRLEPEDFAVYYCQQYGSSPAITFGQGTRLEIK | 918 | QQYGSSPAIT | KAPPA |
| 1.3M | COVD21_P1_HC_C6-p1369 | 919 | EVQLVQSGAEVKKPGESLKISCKGSGYSFTTYCIGWVRQMPGKGLEWMGIIYPGDSDTRYSPSFQGQVTISADKSISTAYLQWSSLKASDTAMYYCARHWYYGDYGNYSYYYLDVVVGKGTTVTVSS | 920 | ARHWYYGDYGNYSYYYLDV | COVD21_P2_K_C6-p1389 | 921 | EIVMTQSPATLSVSPGERATLSCRASQVSSNLAWYQQKPGQAPRLLIYGASTRATGIPARFSGSGSGTEFTLTISSLQSEDFAVYYCQQYNNWPLTFGGGTKVEIK | 922 | QQYNNWPLT | KAPPA |
| 1.3M | COVD21_P1_HC_C8-p1369 | 923 | EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDWGDYYFDYWGQGTLVTVSS | 924 | ARDWGDYYFDY | COVD21_P2_K_C8-p1389 | 925 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIK | 926 | QQYGSSPRT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 1.3M | COVD21_P1_HC_D1-p1369 | 927 | EVQLLESGGGLVQPGGSLRLSCAASGFTFSSYAMSWVRQAPGKGLEWVSAISGSGDITYYADSVKGRFTISRDNSKNTLYLQMNSLRAEDTAVYYCAKDSGTAMVEIFDYWGQGTLVTVSS | 928 | AKDSGTAMVEIFDY | COVD21_P2_K_D1-p1389 | 929 | DIQMTQSPXSLSASVGDRVTITCRASQSISSYLNWYQQKPGKAPKLLIYAASSLQSGVPSRFSGSGSGTDFTLTISSLQPEDFATYFCQQSYSSTLTFGGGTKVEIK | 930 | QQSYSSTLT | KAPPA |
| 1.3M | COVD21_P1_HC_D2-p1369 | 931 | QVQLVESGGGLVKPGGSLRLSCAASGFIFSDYYMSWIRQAPGKGLEWVSYISSSASTIYYADSVKGRFTISRDNAKNSLYLQMNSLRAEDTAVYYCARGLVYTPYRFGYWGQGTLVTVSS | 932 | ARGLVYTPYRFGY | COVD21_P2_K_D2-p1389 | 933 | DIQMTQSPSSLSASVGDRVTITCQASQDISNYLNWYQQKPGKAPKLLIYDASNLETGVPSRFSGSGSGTDFTFTISSLQPEDIATYYCQQHDNVVTFGPGTKVEIK | 934 | QQHDNVVT | KAPPA |
| 1.3M | COVD21_P1_HC_D4-p1369 | 935 | QVQLVESGGGVVQPGRSLRLSCAASGFTFSNYGMHWVRQAPGKGLEWVAVISYDGSNKYFADSVKGRFTISRDNSKNTLYLQMNSLRAEDTAVYYCARATCSGGSCLFGQNAFDIWGQGTMVTVSS | 936 | ARATCSGGSCLFGQNAFDI | COVD21_P2_K_D4-p1389 | 937 | DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPPYTFGQGTKLEIK | 938 | MQGTHWPPYT | KAPPA |
| 1.3M | COVD21_P1_HC_D8-p1369 | 939 | QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCARDGTSITLITEGDAFDIWGQGTMVTVSS | 940 | ARDGTSITLITEGDAFDI | COVD21_P2_K_D8-p1389 | 941 | DIQMTQSPSSVSASVGDRVTITCRASQGISSWLAWYQQKPGKAPKLLIYAASSLQSGVPSRFSGSGSGTDFTLTISSLQPEDFATYYCQQANSLPLTFGGGTKVEIK | 942 | QQANSLPLT | KAPPA |
| 1.3M | COVD21_P1_HC_E11-p1369 | 943 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 944 | AKEGRPSDIVVVVAFDY | COVD21_P2_K_E11-p1389 | 945 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 946 | QQSYSTPRT | KAPPA |
| 1.3M | COVD21_P1_HC_E12-p1369 | 947 | QVQLVESGGGVVQPGRSLRLSCAASGFTFRRYGIHWVRQAPGKGLEWVAVISYDGSNKYYADSVKGRFTISRDNSKNTLYLQMNSLRAEDTAVYYCAKASGEYCGGGSCYRGVFDYWGQGTLVTVSS | 948 | AKASGEYCGGGSCYRGVFDY | COVD21_P2_K_E12-p1389 | 949 | DIQMTQSPSSLSASVGDRVTITCQASQDISNYLNWYQQKPGKAPELLIYDASNLETGVPSRFSGSGSGTDFTFTISSLQPEDIATYYCQQYDNLPLTFGGGTKVEI | 950 | QQYDNLPLT | KAPPA |
| 1.3M | COVD21_P1_HC_E1-p1369 | 951 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 952 | AKEGRPSDIVVVVAFDY | COVD21_P2_K_E1-p1389 | 953 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 954 | QQSYSTPRT | KAPPA |
| 1.3M | COVD21_P1_HC_E6-p1369 | 955 | QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARTMYYYDSSGSFDYWGQGTLVTVSS | 956 | ARTMYYYDSSGSFDY | COVD21_P2_K_E6-p1389 | 957 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPHTFGGGTKVEIK | 958 | MQALQTPHT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P1_HC_F10-p1369 | 959 | QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPHCSGGSCYDAFDIWGQGTMVTVSS | 960 | AAPHCSGGSCYDAFDI | COVD21_P2_K_F10-p1389 | 961 | EIVLTQSPXSLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 962 | QQYGSSPWT | KAPPA |
| 1.3M | COVD21_P1_HC_F12-p1369 | 963 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARVLYYYDSSGYPNLEYFQHWGQGTLVTVSS | 964 | ARVLYYYDSSGYPNLEYFQH | COVD21_P2_K_F12-p1389 | 965 | DIQMTQSPSSLSASVGDRVTITCQASQDISNYLNWYQQKPGKAPKLLIYDASNLEAGVPSRFSGSGSGTDFTFTISSLQPEDIATYYCQQYDNLPSFTFGPGTXVDIK | 966 | QQYDNLPSFT | KAPPA |
| 1.3M | COVD21_P1_HC_F6-p1369 | 967 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 968 | AKEGRPSDIVVVVAFDY | COVD21_P2_K_F6-p1389 | 969 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 970 | QQYSTSRT | KAPPA |
| 1.3M | COVD21_P1_HC_F7-p1369 | 971 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDDSSGYHYYFDYWGQGTLVTVSS | 972 | AKDDSSG | COVD21_P2_K_F7-p1389 | 973 | DIQMTQSPSSLSASVGDRVTITCRASQSISSYLNWYQQKPGKAPKLLIYAASSLQSGVPSRFSGSGSGTDFTLTISSLQPEDFATYYCQQSYNTPPITFGPGTKVDIK | 974 | QQSYNTPPIT | KAPPA |
| 1.3M | COVD21_P1_HC_G11-p1369 | 975 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDGAVVRFLEWPTVGYYYYYMDVWGKGTTVTVSS | 976 | ARDGAVVRFLEWPTVGYYYYYMDV | COVD21_P2_K_G11-p1389 | 977 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGQGTRLEIK | 978 | MQALQTPIT | KAPPA |
| 1.3M | COVD21_P1_HC_G1-p1369 | 979 | QVQLQESGPGLVKPSQTLSLTCTVSGGSISSGGYYWSWIRQHPGKGLEWIGYIYYSGSTYYNPSLESRVTISVDTSKNQFSLKLSSVTAADTAVYYCASGELSAFGELFPHDYWGXGTLVTVSS | 980 | ASGELSAFGELFPHDY | COVD21_P2_K_G1-p1389 | 981 | EIVLTQSPATLSLSPGERATLSCRASQSVSTYLAWYQQKPGQAPRLLIYDASNRATGIPARFSGSGSGTDFTLTISSLEPEDFAVYYCQQRSNWLFTFGPGTKVDIK | 982 | QQRSNWLFT | KAPPA |
| 1.3M | COVD21_P1_HC_G2-p1369 | 983 | QVQLVESGGGVVQPGRSLRLSCAASGFTFSSYAMHWVRQAPGKGLEWVAVISYDGSNKYSADSVKGRFTISRDNSKNTLYLQMNSLRAEDTAVYYCARDCGGDCYPTTDAFDIWGQGTMVTVSS | 984 | ARDCGGDCYPTTDAFDI | COVD21_P2_K_G2-p1389 | 985 | DIQMTQSPSSLSASVGDRVTITCRASQSISSYLNWYQQKPGIAPKLLIYAASSLQSGVPSRFSGIGSGTDFTLTISSLQPEDFATYYCQQSYSTPWTFGQGTKVEIK | 986 | QQSYSTPWT | KAPPA |
| 1.3M | COVD21_P1_HC_G6-p1369 | 987 | QVQLVQSGAEVKKPGSSVKVSCKASGGTFSSYAISWVRQAPGQGLEWMGGIIPIFYTANYAQKFQGRVTITADKSTSTAYMELSSLRSEDTAVYYCARDEGYCSGGSCYGYYYGMDVVVGQGTTVTVSS | 988 | ARDEGYCSGGSCYGYYYGMDV | COVD21_P2_K_G6-p1389 | 989 | DIQMTQSPSSLSASVGDRVTITCQASQDISNYLNWYQQKPGKAPKLLIYDASNLETGVPSRFSGSGSGTDFTFTISSLQPEDIATYYCQQYDNLPMYTFGQGTKLEIK | 990 | QQYDNLPMYT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P1_HC_G8-p1369 | 991 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKNQNSYGYLSYFDYWGQGTLVTVSS | 992 | AKNQNSYGYLSYFDY | COVD21_P2_K_G8-p1389 | 993 | DIQMTQSPSSLSASVGDRVTITCQASQDINNYLNWYQQKPGKAPKLLIYDASNLETGVPSRFSGSGSGTDFAFTISSLQPEDIATYYCQQYDNLPRTFGQGTKVEIK | 994 | QQYDNLPRT | KAPPA |
| 1.3M | COVD21_P1_HC_G9-p1369 | 995 | QVQLVESGGGVVQPGRSLRLSCAASGFTFSSYGMHWVRQAPGKGLEWVAVISYDGSSKFYADSVKGRFTISRDNSKNTLYLQMNSLRAEDTAVYYCARDYGSSWYQVPDYWGQGTLVTVSS | 996 | ARDYGSSWYQVPDY | COVD21_P2_K_G9-p1389 | 997 | DIQMTQSPSSLSASVGDRVTITCRASQSISSYLNWYQQKPGKAPKLLIYAASSLQSGVPSRFSGSRSGTDFTLTISSLQPEDFATYYCQQSYSTPPLTFGGGTKVEIK | 998 | QQSYSTPPLT | KAPPA |
| 1.3M | COVD21_P1_HC_H5-p1369 | 999 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARVPSVGDCSSTSCLYWYFDLWGRGTLVTVSS | 1000 | ARVPSVGDCSSTSCLYVVYFDL | COVD21_P2_K_H5-p1389 | 1001 | DIQMTQSPVSLSASVGDRVTITCRASQSISSWLAWYQQKPGKAPKLLIYKASSLESGVPSRFSGSGSGTEFTLTISSLQPDDFATYYCQQYNSYSTFGQGTKVEIK | 1002 | QQYNSYST | KAPPA |
| 1.3M | COVD21_P1_HC_H7-p1369 | 1003 | EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARYCSGGSCHPPGQWLSDAFDIWGQGTMVTVSS | 1004 | ARYCSGGSCHPPGQ | COVD21_P2_K_H7-p1389 | 1005 | DIQMTQSPXSLSASVGDRVTITCRASQSISSYLNWYQQKPGKAPKLLIYAASSLQSGVPSRFSGSGSGTDFTLTISSLQPEDFATYYCQQSYSTWTFGQGTKVEIK | 1006 | QQSYSTWT | KAPPA |
| 1.3M | COVD21_P1_HC_H9-p1369 | 1007 | QVQLVQSGAEVKKPGASVKVSCKASGYTFTGYYMHWVRQAPGQGLEWMGWLNPISGGTNYAQKFQGRVTMTRDTSISTAYMELSRLRSDDTAVYYCASPASRGYSGYDHGYYYYMDVWGKGTTVTVSS | 1008 | ASPASRGYSGYDHGYYYYMD | COVD21_P2_K_H9-p1389 | 1009 | DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK | 1010 | QQYDNLPIT | KAPPA |
| 1.3M | COVD21_P2_HC_A10-p1369 | 1011 | EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARVGYDSSGYSGWYFDLWGRGTLVTVSS | 1012 | ARVGYDSSGYSGWYFDL | COVD21_P1_K_A10-p1389 | 1013 | DIQMTQSPSSLSASVGDRVTITCRASQSISSYLNWYQQKPGKAPKVLIYAASSLQSGVPSRFSGSGSGTDFTLTISSLQPEDFATYYCQQSYSTPPLTFGGGTKVEIK | 1014 | QQSYSTPPLT | KAPPA |
| 1.3M | COVD21_P2_HC_A11-p1369 | 1015 | QVQLVESGGGVVQPGRSLRLSCAASGFTYSGYAMHWVRQAPGKGLEWVAVILDDGSNKYYADSVKGRFTISRDNSKNTLYLQMNSLRAEDTAVYYCARDGIVDTAMVTWFDYWGQGTLVTVSS | 1016 | ARDGIVDTAMVTWFDY | COVD21_P1_K_A11-p1389 | 1017 | DIQMTQSPSSLSASVGDRVTITCRASQSISSYLNWYHQKPGKAPKLLIYTASSLQSGVPSRFSGSGSGTDFTLTISSLQPEDFATYYCQQSYSTPPWTFGQGTKVEIK | 1018 | QQSYSTPPWT | KAPPA |
| 1.3M | COVD21_P2_HC_A4-p1369 | 1019 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 1020 | AKEGRPSDIVVVVAFDY | COVD21_P1_K_A4-p1389 | 1021 | DIQMTQSPSSLSASVGDRVTITCRASQSISSYLNWYQQKPGKAPKLLIYAASSLQSGVPSRFSGSGSGTDFTLTISSLQPED 1022 | 1022 | QQSYSTPRT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P2_HC_B10-p1369 | 1023 | QLQLQESGPGLVKPSETLSVTCTVSGGSISSSRYYWGWIRQPPGKGLEWIGSIYYSGSTYYNPSLKSRVTISVDTSKNQFSLKLSSVTAADTAVYYCARHAAAYYDRSGYYFIEYFQHWGQGTLVTVSS | 1024 | ARHAAAYYDRSGYYFIEYFQH | COVD21_P1_K_B10-p1389 | 1025 | DIQMTQSPSTLSASVGDSVTITCRASQSISSWLAWYQQKPGKAPKLLIYKASSLESGVPSRFSGSGSGTEFTLTISSLQPDDFATYYCQQYNNYRYTFGQGTKLEIK | 1026 | QQYNNYRYT | KAPPA |
| 1.3M | COVD21_P2_HC_B11-p1369 | 1027 | QVQLVESGGGVVQPGRSLRLSCAASGFTFSSYGMHWVRQAPGKGLEWVAVIWHDGSNKYYADSVKGRFTISRDNSKNTLYLQMNSLRAEDTALYYCARDPSVVVTAIDFDYWGQGTLVTVSS | 1028 | ARDPSVVVTAIDFDY | COVD21_P1_K_B11-p1389 | 1029 | DVVMTQSPLSLPVTLGQPASISCRSSQSLVFSDGNTYLNWFQQRPGQSPRRLIYKVSNRDSGVPDRFSGSGSGTDFTLKISRVEAEDVGVYFCMQGTHWPWTFGQGTKVEIK | 1030 | MQGTHWPWT | KAPPA |
| 1.3M | COVD21_P2_HC_B2-p1369 | 1031 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGNRLLYCSSTSCYLDAVRQGYYYYYYMDVWGKGTTVTVSS | 1032 | ARGNRLLYLDAVRQGYYYYYYMDV | COVD21_P1_K_B2-p1389 | 1033 | EIVLTQSPATLSLSPGERATLSCRASQSSYLAWYQQKPGQAPRLLIYDASNRATGIPARFSGSGSGTDFTLTISSLEPEDFAVYYCQQRSNWPLTFGGGTKVEIK | 1034 | QQRSNWPLT | KAPPA |
| 1.3M | COVD21_P2_HC_B5-p1369 | 1035 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 1036 | AKEGRPSDIVVVVAFDY | COVD21_P1_K_B5-p1389 | 1037 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 1038 | QQSYSTPRT | KAPPA |
| 1.3M | COVD21_P2_HC_C12-p1369 | 1039 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 1040 | AKEGRPSDIVVVVAFDY | COVD21_P1_K_C12-p1389 | 1041 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 1042 | QQSYSTPRT | KAPPA |
| 1.3M | COVD21_P2_HC_C4-p1369 | 1043 | EVQLLESGGGLVQPGGSLRLSCAASGFTFNSYAMSWVRQAPGKGLEWVSGISGSGDSTYYADSVKGRFTISRDNSKNTVYLQMNSLRAEDTAVYYCAKDGGRQWLVELLDYWGHGTLVTVS | 1044 | AKDGGRQWLVELLDY | COVD21_P1_K_C4-p1389 | 1045 | DIQMTQSPSSLSASVGDRVTITCRASQSIASYLNWFQQKPGKAPKLLIYAASQSGVPSRFSGSGSGTDFTLTISSLQPEDFATYCCQQSYSSPPTFGQGTKLEIK | 1046 | QQSYSSPPT | KAPPA |
| 1.3M | COVD21_P2_HC_C8-p1369 | 1047 | QVQLVQSGAEVKKPGASVKVSCKASGYTFTGYYMHWVRQAPGQGLEWMGWINPISGGTNYAQKFQGRVTMTRDTSISTAYMELSRLRSDDTAVYYCASPASRGYSGYDHGYYYYMDVWGKGTTVTVSS | 1048 | ASPASRGYSGYDHGYYYYMDV | COVD21_P1_K_C8-p1389 | 1049 | DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK | 1050 | QQYDNLPIT | KAPPA |
| 1.3M | COVD21_P2_HC_C9-p1369 | 1051 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREHTPTDIVVVNVEYWGQGTLVTVS | 1052 | AREHTPTDIVVVNVEY | COVD21_P1_K_C9-p1389 | 1053 | DVVMTQSPLSLPVTLGQPASISCRSSQSLVYIDGNTYLNWFQQRPGQSPRRLIYKVSNRDSGVPDRFSGSGSGTDFTLKISRVEAEDVGVYYCMQGTHWPYTFGQGTKLEIK | 1054 | MQGTHWPYT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P2_HC_D1-p1369 | 1055 | QVQLVESGGGVVQPGRSLRLSCAASGFTFSSYAMHWVRQAPGKGLEWVAVILYDGSNKYYADSVKGRFTISRDNSKNTLYLQMNSLRAEDTAVYYCARDQGMATTYFDYWGQGTLVTVSS | 1056 | ARDQGMATTYFDY | COVD21_P1_K_D1-p1389 | 1057 | DIQMTQSPSSLSASVGDRVTITCRASQSISSYLNWYQQKPGKAPKLLIYAASQSGVPSRFSGSGSGTDFTLTISSLQPEDFATYFCQQSYNTPPWTFGQGTKVEIK | 1058 | QQSYNTPPWT | KAPPA |
| 1.3M | COVD21_P2_HC_D3-p1369 | 1059 | EVQLVESGGGLVQPGGSLRLSCAASGFTFSSYDMHWVRQATGKGLEWVSIIGTAGDTYYPGSVKGRFTISRENAKNSLYLQMNSLRAGDTAVYYCARGSYSNYVGYMDVWGKGTTVTVS | 1060 | ARGSYSNYVGYMDV | COVD21_P1_K_D3-p1389 | 1061 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPGLTFGGGTKVEIK | 1062 | QQSYSTPGLT | KAPPA |
| 1.3M | COVD21_P2_HC_D8-p1369 | 1063 | EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARAWAMRQTTLTPEWIDYWGQGTLVTVSS | 1064 | ARAWAMRQTTLTPEWIDY | COVD21_P1_K_D8-p1389 | 1065 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIK | 1066 | QQYGSSPYT | KAPPA |
| 1.3M | COVD21_P2_HC_E10-p1369 | 1067 | EVQLVESGGGLVQPGRSLRLSCAASGFTFDDYAMHWVRQAPGKGLEWVSGISWNSGTIGYADSVKGRFTISRDNAKNSLYLQMNSLRAEDTAFYYCAKAGVRGIAAAGPDLNFDHWGQGTLVTVSS | 1068 | AKAGVRGIAAAGPDLNFDH | COVD21_P1_K_E10-p1389 | 1069 | EIVLTQSPATLSLSPGERATLSCRASQSVSSYLAWYQQKPGQAPRLLIYDASNRATGIPARFSGSGSGTDFTLTISSLEPEDFAVYYCQQRITFGQGTRLEIK | 1070 | QQRIT | KAPPA |
| 1.3M | COVD21_P2_HC_E4-p1369 | 1071 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 1072 | AKEGRPSDIVVVVAFDY | COVD21_P1_K_E4-p1389 | 1073 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 1074 | QQSYSTPRT | KAPPA |
| 1.3M | COVD21_P2_HC_E9-p1369 | 1075 | EVQLVESGGDLVKPGGSLRLSCAASGFTFNNAWMSWVRQAPGKGLEWVGRIKDKSDGETTDYAAPVQGRFTVSRDDSKNTLYLQMNSLKTEDTAVYYCTTGPHYDSSGYSYTVDSWGQGTLVTVSS | 1076 | TTGPHYDSSGYSYTVDS | COVD21_P1_K_E9-p1389 | 1077 | DIVMTQSPLSLPVXPGEPASISCRSSQSLLHSNGFHFLEWYLQKPGQSPQLLIYSGSNRASGVPDRFSGSGSGTHFTLKISRVEAEDVGVYYCMQGLQTPLTFGGGTKVEIK | 1078 | MQGLQTPLT | KAPPA |
| 1.3M | COVD21_P2_HC_F12-p1369 | 1079 | QVQLVQSGAEVKKPGASVKVSCKASGYTFTGYYMHWVRQAPGQGLEWMGWINPISGGTNYAQKFQGRVTMTRDTSISTAYMELSRLRSDDTAVYYCASPASRGYSGYDHGYYYYMDVWGKGTTVTVSS | 1080 | ASPASRGYSGYDHGYYYYMDV | COVD21_P1_K_F12-p1389 | 1081 | DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK | 1082 | QQYDNLPIT | KAPPA |
| 1.3M | COVD21_P2_HC_F1-p1369 | 1083 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 1084 | AKEGRPSDIVVVVAFDY | COVD21_P1_K_F1-p1389 | 1085 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 1086 | QQSYSTPRT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P2_HC_F7-p1369 | 1087 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDYGDFYFDYWGQGTLVTVSS | 1088 | ARDYGDFYFDY | COVD21_P1_K_F7-p1389 | 1089 | DIQMTQSPSSLSASVGDRVTITCRASQGISNSLAWYQQKPGKAPKLLLYAASRLESGVPSRFSGSGSGTDYTLTINSLQPEDFATFYCQQYYSTPRTFGQGTKVEIK | 1090 | QQYYSTPRT | KAPPA |
| 1.3M | COVD21_P2_HC_F9-p1369 | 1091 | QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPHCSGGSCLDAFDIWGQGTMVTVSS | 1092 | AAPHCSGGSCLDAFDI | COVD21_P1_K_F9-p1389 | 1093 | EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPWTFGQGTKVEIK | 1094 | QQYGSSPWT | KAPPA |
| 1.3M | COVD21_P2_HC_G2-p1369 | 1095 | EVQLVESGGGLVKPGGSLRLSCAASGFTFSNAWMNWVRQAPGKGLEWVGRIKDKSDGGTIDYAAPVQGRFTISRDDSKNTLYLQMNSLKTEDTAVYYCTTGPHYDDSGYSYTVDYWGQGTLVTVSS | 1096 | TTGPHYDDSGYSYTVDY | COVD21_P1_K_G2-p1389 | 1097 | DIVMTQSPLSLPVTPGEPASISCRSSQSLLHSNGFHFLDWYLQKPGQTPQLLIYVGSNRASGVPDRFSGSGSGTDFTLKISRVEAEDVGVYYCMQALQTPLTFGGGTKVEIK | 1098 | MQALQTPLT | KAPPA |
| 1.3M | COVD21_P2_HC_G4-p1369 | 1099 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKASGIYCSGGDCYSYYFDYWGQGTLVTVSS | 1100 | AKASGIYCSGGDCYSYYFDY | COVD21_P1_K_G4-p1389 | 1101 | DIQMTQSPSTLSASVGDRVTITCRASQSISSWLAWYQQKPGKAPKLLIYKASSLESGVPSRFSGSGSGTEFTLTISSLQPDDFATYYCQQYNSYSTFGQGTKVEIK | 1102 | QQYNSYST | KAPPA |
| 1.3M | COVD21_P2_HC_G5-p1369 | 1103 | QVQLVQSGAEVKKPGASVKVSCKASGYTFTSYYMHWVRQAPGQGLEWMGIINPSGGSTTYAQKFQGRVTMTRDTSTSTVYMELSSLRSEDTAVYYCARDRAETEGSETYYYDSSGYYLLGYWGQGTLVTVSS | 1104 | ARDRAETEGSETYYYDSSGYYLLGY | COVD21_P1_K_G5-p1389 | 1105 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPSFGQGTKVEIK | 1106 | QQSYSTPPS | KAPPA |
| 1.3M | COVD21_P2_HC_G9-p1369 | 1107 | EVQLLESGGGLVQPGGSLRLSCAASRFTFSNYAMSWVRQAPGKGLEWVSTISGSGGSTYYADSVKGRFTISRDNSKNTLYLQMNSLRAEDTAVYYCAKDRAAAHWATDYWGQGTLVTVSS | 1108 | AKDRAAAHWATDY | COVD21_P1_K_G9-p1389 | 1109 | DIQMTQSPXXLSASVGDRVTITCQASQDISNYLNWYQQKPGKAPKLLIYDASNLETGVPSRFSGSGSGTDFTFTISSLQPEDIATYYCQQYDNRLFTFGPGTKVDIK | 1110 | QQYDNRLFT | KAPPA |
| 1.3M | COVD21_P2_HC_H10-p1369 | 1111 | QVQLVESGGGVVQPGRSLRLSCAASGFTFSSYAMHWVRQAPGKGLEWVAVISYDGSSKYYADSVKGRFTISRDNSKNTLYLQMNSLRAEDTAVYYCARDHDYGEIVDAFDIWGQGTMVTVSS | 1112 | ARDHDYGEIVDAFDI | COVD21_P1_K_H10-p1389 | 1113 | DIQMTQSPSSLSASVGDRVTITCRASQSISSYLNWYQQRPGKAPKLLIYAASSLQSGFPSRFSGSGSGTDFTLTISSLQPEDFATYYCQQSYSTLMYTFGQGTKLEI | 1114 | QQSYSTLMYT | KAPPA |
| 1.3M | COVD21_P2_HC_H11-p1369 | 1115 | QLQLQESGPGLVKPSETLSLTCTVSGGSISSSNYYWGWIRQPPGKGLEWIGSIYYSGSTYYNPSLKSRVTISVDTSKNQFSLKVSSVTAADTAVYYCARHAAAYYDRSGYYFIEYFQHWGXGTLVTVSS | 1116 | ARHAAAYYDRSGYYFIEYFQH | COVD21_P1_K_H11-p1389 | 1117 | DIQMTQSPSTLSASVGDRVTITCRASQSISSWLAWYQQKPGKAPKLLIYKASSLESGVPSRFSGSGSGTEFTLTISSLQPDDFATYYCQKYNSYRYTFGQGTKLEIK | 1118 | QKYNSYRYT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P2_HC_H4-p1369 | 1119 | EVQLVQSGAEVKKPGESLKISCKGSGYSFSSYCIGWVRQMPGKGLEWMGIIYPGDSDTRYSPSFQGQVTISVDKSISTAYLQWSSLKASDTAMYYCARQWRGYYDRSGYYHFDAFDIWGQGTMVTVSS | 1120 | ARQWRGYYDRSGYYHFDAFDI | COVD21_P1_K_H4-p1389 | 1121 | EIVMTQSPATLSVSPGERATLSCRASQSVSSNLAWYQQKSGQAPRLLIYGASTRATGIPARFSGSGSGTEFTLTISSLQSEDFAVYYCQQYNNWLGTFGQGTKVEFK | 1122 | QQYNNWLGT | KAPPA |
| 1.3M | COVD21_P2_HC_H7-p1369 | 1123 | QVQLVESGGGVVQPGRSLRLSCAASGFTFSSYAMHWVRQAPAKGLEWVAVILYDGSGKYYADSVKGRFTISRDNSKNTLYLQMNSLRAEDTAVYYCARDGIVDTALVTWFDYWGQGTLVTVSS | 1124 | ARDGIVDTALVTWFDY | COVD21_P1_K_H7-p1389 | 1125 | DIQMTQSPSSLSASVGDRVTITCRASQSISTYLNWYQQKPGKAPKLLIYAASSLQSGVPSRFSGSGSGTDFTLTISSLQPEDFATYYCQQSYSTPPWTFGQGTKVEIK | 1126 | QQSYSTPPWT | KAPPA |
| 1.3M | COVD21_P2_HC_H9-p1369 | 1127 | QVQLVESGGGVVQPGRSLRLSCAASGFTFSSYGMHWVRQAPGKGLEWVTVISYDGRNKYYADSVKGRFTISRDNSKNTLYLQMNSLRAEDTAVYYCAREFGDPEWYFDYWGQGTLVTVSS | 1128 | AREFGDPEWYFDY | COVD21_P1_K_H9-p1389 | 1129 | DIQMTQSPSTLSASVGDRVTITCRANQSISSWLAWYQQKPGKAPKLLIYKASSLESGVPSRFSGSGSGTEFTLTISSLQPDDFATYYCQQYNSYWTFGQGTKVEIK | 1130 | QQYNSYWT | KAPPA |
| 1.3M | COVD21_P3_HC_A4-p1369 | 1131 | QVQLVESGGGVVQPGRSLRLSCAASGFTFSRYGMHWVRQAPGKGLEWVAVISYDGSNKYYADSVKGRFTISRDNSKNTLYLQMNSLRAEDTAVYYCAKVTAPYCSGGSCYGGNFDYWGQGTLVTVSS | 1132 | AKVTAPYCSGGSCYGGNFDY | COVD21_P3_K_A4-p1389 | 1133 | DIQMTQSPSSLSASVGDRVTITCQASQDISNYLNWYQQKPGKAPKLLIYDASNLETGVPSRFSGSGSGTDFTFTINSLQPEDIATYYCQQYDNLPPTFGGGTKVEIK | 1134 | QQYDNLPPT | KAPPA |
| 1.3M | COVD21_P3_HC_A6-p1369 | 1135 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 1136 | AKEGRPSDIVVVVAFDY | COVD21_P3_K_A6-p1389 | 1137 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 1138 | QQSYSTPRT | KAPPA |
| 1.3M | COVD21_P3_HC_B10-p1369 | 1139 | EVQLVESGGGLVKPGGSLRLSCAASGFTFTNAWMNWVRQAPGKGLEWVGRIKAMTDGGTTDYAAPVQGRFTISRDDSRNTLYLQMNSLKTEDTAVYSCTTGPQYDDNGYSYTVDYWGQGTLVTVSS | 1140 | TTGPQYDDNGYSYTVDY | COVD21_P3_K_B10-p1389 | 1141 | DIVMTQSPLSLPVTPGEPASISCRXSQSLLHSNGFHFVDWYLQKPGQSPHLLIYLGSNRASGVPDRFSGSGSGTDFTLKISRVEAEDVGVYYCMQALQTPLTFGGGTKVEIK | 1142 | MQALQTPLT | KAPPA |
| 1.3M | COVD21_P3_HC_B12-p1369 | 1143 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 1144 | AKEGRPSDIVVVVAFDY | COVD21_P3_K_B12-p1389 | 1145 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 1146 | QQSYSTPRT | KAPPA |
| 1.3M | COVD21_P3_HC_B9-p1369 | 1147 | QVQLVESGGGVVQPGRSLRLSCAASGFTFSNYAIHWVRQAPGKGLEWVAVISYDGSNKYYADSVKGRFTISRDNSKNTLYLQMNSLRAEDTAVYYCARDFDDSSFWAFDYWGQGTLVTVSS | 1148 | ARDFDDSSFWAFDY | COVD21_P3_K_B9-p1389 | 1149 | DIQMTQSPSSLSASVGDRVTITCRASQSIRSYLNWYQQKPGKAPKLLIYAASSLQSGVPSRFSGSGSGTDFTLTISSLQPDDFATYYCQQSYSTPPATFGQGTKLEIK | 1150 | QQSYSTPPAT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P3_HC_E11-p1369 | 1151 | EVQLVESGGGLVQPGGSLRLSCAASGFTFSSYDMHWVRQATGKGLEWVSTIGTAGDTYYPGSVKGRFTISRENAKNSLYLQMNSLRAGDTAVYYCARVGYSSGWAYWYVDLWGRGTLVTVSS | 1152 | ARVGYSSGWAYWYVDL | COVD21_P3_K_E11-p1389 | 1153 | DIQMTQSPSSLSASVGDRVTITCRASQSISSFLNWYQQKPGKAPKLLIYAASSLQSGVPSRFSGSGSGTDFTLTISSLQPEDFATYYCQQSYITPQYTFGQGTKVEIK | 1154 | QQSYITPQYT | KAPPA |
| 1.3M | COVD21_P3_HC_E2-p1369 | 1155 | EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKAGVRGIAAAGPDLNFDYWGQGTLVTVSS | 1156 | AKAGVRGIAAAGPDLNFDY | COVD21_P3_K_E2-p1389 | 1157 | EIVLTQSPATLSLSPGERATLSCRASQSVSSYLAWYQQKPGQAPRLLIYDASNRATGIPARFSGSGSGTDFTLTISSLEPEDFAVYYCQQRITFGQGTRLEIK | 1158 | QQRIT | KAPPA |
| 1.3M | COVD21_P3_HC_E7-p1369 | 1159 | QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARVWQYYDSSGSFDYWGQGTLVTVSS | 1160 | ARVWQYYDSSGSFDY | COVD21_P3_K_E7-p1389 | 1161 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGTKVDIK | 1162 | MQALQTPFT | KAPPA |
| 1.3M | COVD21_P3_HC_E9-p1369 | 1163 | EVQLVESGGGLVQPGGSLRLSCAASGFTFSSYDMHWVRQATGKGLEWVSTIGTAGDTYYPGSVKGRFTISRENAKNSLYLQLNSLRAGDTAVYYCARANYDSSGLGLGYFDYWGQGTLVTVSS | 1164 | ARANYDSSGLGLGYFDY | COVD21_P3_K_E9-p1389 | 1165 | DIQMTQSPSSLSASVGDRVTITCRASQRISSYLNWYQQKPGKAPKLLIYAASSLQSGVPSRFSGSGSGTDFTLTISSLQPEDFATYYCQQSYSTPPITFGQGTRLEIK | 1166 | QQSYSTPPIT | KAPPA |
| 1.3M | COVD21_P3_HC_F2-p1369 | 1167 | QVQLVQSGAEVKKPGSSVKVSCKASGGTFSSYAISWVRQAPGQGLEWMGGIIPIFGTTNYAQKFQGRVTITADESTSTTYMELSSLRSEDTAVYYCAREVDYCSSAYCYADYWGQGTLVTVSS | 1168 | AREVDYCSSAYCYADY | COVD21_P3_K_F2-p1389 | 1169 | DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGPGTKVDIK | 1170 | QQYYSTPFT | KAPPA |
| 1.3M | COVD21_P3_HC_F3-p1369 | 1171 | QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARVWQYYDSSGSFDYWGQGTLVTVSS | 1172 | ARVWQYYDSSGSFDY | COVD21_P3_K_F3-p1389 | 1173 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGTKVDIK | 1174 | MQALQTPFT | KAPPA |
| 1.3M | COVD21_P3_HC_F5-p1369 | 1175 | QVQLVESGGGVVQPGRSLRLSCAASGFTFSSYGMHWVRQAPGKGLEWVAVISYDGSNKYYADSVKGRFTISRDNSKNTLYLQMSSLRAEDTAVYYCAKQIGEYCSGGSCYQGSLDYWGQGTLVTVSS | 1176 | AKQIGEYCSGGSCYQGSLDY | COVD21_P3_K_F5-p1389 | 1177 | DIQMTQSPVSLSASVGDRVTITCQASQDISNYLHWYQQKPGKAPKLLIYDASNLETGVPSRFSGSGSGTDFTFTISSLQPEDIATYYCQQYDNLPFTFGPGTKVDAK | 1178 | QQYDNLPFT | KAPPA |
| 1.3M | COVD21_P3_HC_G11-p1369 | 1179 | EVQLVESGGDLVKPGGSLRLSCAASGFTFNNAWMSWVRQAPGKGLEWVGRIKDKSDGETTDYAAPVQGRFTVSRDDSKNTLYLQMNSLKTEDTAVYYCTTGPHYDSSGYSYTVDSWGQGTLVTVSS | 1180 | TTGPHYDSSGYSYTVDS | COVD21_P3_K_G11-p1389 | 1181 | DIVMTQSPLSLPVTPGEPASISCRSSQSLLHSTGFHFLEWYLQKPGQSPQLLIYSGSNRASGVPDRFSGSGSGTHFTLKISRVEAEDVGIYYCMQGLQTPLTFGGGTKVEIK | 1182 | MQGLQTPLT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD21_P3_HC_G5-p1369 | 1183 | QVQLVQSGAEVKKPGASVKVSCKASGYTFTSYYMHWVRQAPGQGLEWMGIINPSGGSTTYAQKFQGRVTMTRDTSTSTVYMELSSLRSEDTAVYYCARDRAETEGSETYYYDSSGYYLLGYWGQGTLVTVSS | 1184 | ARDRAETEGSETYYYDSSGYYLLGY | COVD21_P3_K_G5-p1389 | 1185 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPSFGQGTKVEIK | 1186 | QQSYSTPPS | KAPPA |
| 1.3M | COVD21_P3_HC_G6-p1369 | 1187 | QVQLVESGGGLVKPGGSLRLSCAASGFTFSDYYMSWIRQAPGKGLEWVSYISSSGNSIYSADSVKGRFTISRDNAKNSLYLQMNSLRAEDTAVYYCATPPGGNPTYYYDTSGYSLAYWGQGTLVTVSS | 1188 | ATPPGGNPTYYYDTSGYSLAY | COVD21_P3_K_G6-p1389 | 1189 | DVVMTQSPLSLPVTLGQPASISCRSSQSLVYSDGNTYLNWFQQRPGQSPRRLIYNVSNRDSGVPDRFSGSGSGTDFTLKISRVEAEDVGVYYCMQGTHWPPNFGQGTRLEIK | 1190 | MQGTHWPPN | KAPPA |
| 1.3M | COVD21_P3_HC_G8-p1369 | 1191 | QLQLQESGPGLVKPSETLSLTCTVSGGSISSSNYYWGWIRQPPGKGLEWIGSIYYSGSTYYNPSLKSRVTISVDTSKSQFSLKLSSVTAADTAVYYCARALKYYDILTGYSEPRTFLDYWGQGTLVTVSS | 1192 | ARALKYYDILTGYSEPRTFLDY | COVD21_P3_K_G8-p1389 | 1193 | DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK | 1194 | QQYDNLPIT | KAPPA |
| 1.3M | COVD21_P3_HC_H10-p1369 | 1195 | EVQLVESGGGLVQPGGSLRLSCAASGFNFSTHWMHWVRQAPGKGLVWVSRINSDGSRRAYATSVKGRFTISRDNAKNTLYLQMDSLRDEDTAVYYCTRDDSSWPHFFDNWGQGTLVTVSS | 1196 | TRDDSSWPHFFDN | COVD21_P3_K_H10-p1389 | 1197 | DIQMTQSPSSLSASVGDRVTITCRASQSISSYLNWYQQKPGKAPKLLIYVASSLQSGVPSRFSGSGSGTDFTLTISSLQPEDFATYYCQQSYSTRTFGQGTKVEIK | 1198 | QQSYSTRT | KAPPA |
| 1.3M | COVD21_P3_HC_H2-p1369 | 1199 | EVQLLESGGGLVQPGGSLRLSCAASGFTFSSYAMSWVRQAPGKGLEWVSGISDSGVSTYYADSVKGRFTISRDNSKNTLYLQMNSLRAEDTAVYYCANHGDYVGYMDVWGKGTTVTVSS | 1200 | ANHGDYVGYMDV | COVD21_P3_K_H2-p1389 | 1201 | DIQMTQSPSSLSASVGDRVTITCQASQDISNYLNWYQQKPGKAPKLLIYDASNLETGVPSRFSGSGSGTDFTFTISSLQPEDIATYYCQQYDNLPPYTFGQGTKLEIK | 1202 | QQYDNLPPYT | KAPPA |
| 1.3M | COVD21_P3_HC_H3-p1369 | 1203 | EVQLLESGGGLVQPGGSLRLSCAASGFTFSSYAMSWVRQAPGKGLEWVSGMSGSGGITYYADSVKGRFTISRDNSKNTLYLQMNSLRAEDTAVYYCAKDTGSMIVELLGYWGQGTLVTVSS | 1204 | AKDTGSMIVELLGY | COVD21_P3_K_H3-p1389 | 1205 | DIQMTQSPSSLSASVGDRVTITCRASQSISSYLNWYQQKPGKAPKLLIYAASSLQSGVPSRFSGSGSGTDFTLTISSLQPEDFATYFCQQSYSTPGTFGQGTKVEIK | 1206 | QQSYSTPGT | KAPPA |
| 1.3M | COVD21_P3_HC_H4-p1369 | 1207 | QVQLVESGGGVVQPGRSLRLSCATSGFTFSSYGLHWVRQAPGKGLEWVALISYDGSDKYYADSVKGRFTISRDTSKNTLFLQMNSLRAEDTAVYYCAKVMGPYCSGGSCYSGYFDYWGQGTLVTVSS | 1208 | AKVMGPYCSGGSCYSGYFDY | COVD21_P3_K_H4-p1389 | 1209 | EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK | 1210 | QQRSNWPLT | KAPPA |
| 1.3M | COVD21_P3_HC_H7-p1369 | 1211 | QVQLQESGPGLVKPSQTLSLTCTVSGGSISSGGYYWSWIRQHPGKGLEWIEYIYYSGSTYYNPSLKSRVTISVDTSKNQFSLKLSSVTAADTAVYYCARAQAVGANYAAAFDIWGQGTMVTVSS | 1212 | ARAQAVGANYAAAFDI | COVD21_P3_K_H7-p1389 | 1213 | DIQMTQSPSSLSASVGDRVTITCQASQDISNYLNWYQQKPGKAXKLLIYDALNLETGVPSRFSGSGSGTDFTFTISSLQPEDIATYYCQQYDNLPITFGQGTRLEIK | 1214 | QQYDNLPIT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COVD47_mo6_P2HC_B7-p1369 | 1215 | EVQLVESGGGLVQPGGSLRLSCAASGFSVSTKYMTWVRQAPGKGLEWVSVLYSGRTDYYADSVKGRFTISRDSSKNILYLQMSSLRVEDTGFYYCARDSSEVRDHPGHPGRSVGAFDIWSQGTMVTVSS | 1216 | ARDSSEVRDHPGHPGRSVGAFDI | B6c-p1410 | 1217 | QSALTQPASVSGSPGQSIAISCTGTSNDVGSYTLVSWYQQYPGKAPKLLIFEDSQRSSGISNRFSGSKSGNTASLTISGLRGEDEADYYCCSYAGSHTFVFGGGTKVTV | 1218 | CSYAGSHTFV | LAMBDA |
| 6.2M | COVD47_mo6_P1HC_A2-p1369 | 1219 | QVQLQESGPGLVKPSQTLSLTCTVSGGSVRSGGYYWNWIRQHPGKGLQWIGYVNYSGSTDYNPSLESRLTISVDTXKRQFSLKLTSVTAADTAVYYCASSLVPYYFDSWGQGTLVTVSS | 1220 | ASSLVPYYFDS | COVD47_mo6_P1L_A2-p1409 | 1221 | QSVLTQPPSVSGAPGQRITISCTGSSSNIGAGFDVHWYQQVPGTAPKLLIYGNNIRPSGVPDRFSGSKSDTSASLAITGLQSEDEADYFCQSYDNSLSDPYVFGTGTKVTV | 1222 | QSYDNSLSDPYV | LAMBDA |
| 6.2M | COVD47_mo6_P1HC_A3-p1369 | 1223 | EVQLVESGGGLVQPGGSQRLSCAASGFTVSSNYMSWIRQAPGKGLEWVSVIYSGGSAYYVDSVKGRFTISRDNSKNTLYLQMNSLRPEDTAVYYCARIANYMDVWGKGTTVTVSS | 1224 | ARIANYMDV | COVD47_mo6_P1K_A3-p1389 | 1225 | EIVMTQSPATLSVSPGERATLSCRASQSVSSHLAWYQQKPGQAPRLLIYGASTRATGIPTRFSGSGSGTEFTLTISSLQSEDFAVYYCQQYNNWPPLTFGGGTKVEIK | 1226 | QQYNNWPPLT | KAPPA |
| 6.2M | COVD47_mo6_P1HC_A4-p1369 | 1227 | QVQLVQSGAEVKKPGSSVKVSCKASGGSFSSSAINWVRQAPGQGLEWMGGIIPMFGTANYAQNFQGRVTITADGSTSTAYMELNNLKSEDTAVVYCAIDPSAWYPSRSPRLDSWGQGTLVTVSS | 1228 | AIDPSAWYPSRSPRLDS | COVD47_mo6_P1L_A4-p1409 | 1229 | QSVLTQPRSVSGSPGQAVTISCTGTSSAVGVYNHLSWYQQHPGKAPKVMIYDIYKRPSGVPDRFSGSKSGNTASLTISGLQSEDEADYYCCSYAGNYTWGGGTKLTVL | 1230 | SSYISSTTSWV | LAMBDA |
| 6.2M | COVD47_mo6_P1HC_A6-p1369 | 1231 | EVQLVQSGAEVKKSGESLKISCKGSGYSFATYWIGWVRQKPGKGLEWMGIIHPSDSDTKYGPSFQGQVTMSADKSISTAYLQWSSLKTSDTAMYYCARGLSGSYSDDEGVEEWGQGTLVTVSS | 1232 | ARGLSGSYSDDEGVEE | COVD47_mo6_P1K_A6-p1389_R | 1233 | EIVLTQSPATLSLSPGERATLSCRASQSLSPYLAWYQQKPGQAPRLLIYDASNRATGIPARFSGSGSGTDFTLTISSLEPEDFAVYYCLQRSYWPLTFGQGTKVEIK | 1234 | LQRSYWPLT | KAPPA |
| 6.2M | COVD47_mo6_P1HC_A7-p1369 | 1235 | QVQLVQSGAEVKKPGSSVNVSCKASGGTFSTYAIHWVRQAPGQGLEWMGGIIPLFHTANYAQKFQGRVTITADESTSTAYMELSSLRSEDTAMYYCAINTQWDLVPRWGRGTLVTVSS | 1236 | AINTQWDLVPR | COVD47_mo6_P1K_A7-p1389 | 1237 | EIVLTQSPGTLSLAPGERATLSCRASQSVNSNYLAWYQQKPGQAPRLLIYGASSRATGIPDRFSGSGSGTDFTLTISRLEPEDFAVYYCQQYGFSLYSFGQGTKLEIK | 1238 | QQYGFSLYS | KAPPA |
| 6.2M | COVD47_mo6_P1HC_A9-p1369 | 1239 | QVQLQESGPGLVKPSQTLSLTCTVSGGSITSGDYYWNWIRQHPGKGLEWIGYIYYNGGPYNNPSLKSRPTISLDTSKNQFSLKLTSVTAADTAMYYCARGWASSTWCYGCMDVVVGQGTTVTVSS | 1240 | ARGWASSTWCYGCMDV | COVD47_mo6_P1K_A9-p1389 | 1241 | DIVMTQTPLSSPVTLGQPASISCRSSQSLVHSDGNTYLSWLQQRPGQPPRLLIYQISNRFSGVPDRFSGSGAGTDFTLKISRVEAEDVGIYYCTQATQFPHTFGQGTKLEIK | 1242 | TQATQFPHT | KAPPA |
| 6.2M | COVD47_mo6_P1HC_B11-p1369 | 1243 | QVQLVESGGGVVQPGRSLRLSCAASGFTFSSYGIHWVRQAPGKGLEWVAVISYDGTIKSYAGSVKGRFTISKDNSKNTLYLQMNSLRAEDTAVYYCAKDPFPLAVAGTGYFDYWGQGTLVTVSS | 1244 | AKDPFPLAVAGTGYFDY | COVD47_mo6_P1L_B11-p1409 | 1245 | SYVLTQPPSVSVAPGQTARITCGGNDIGSKNVHWYQQKPGQAPVLVVYDDSDRPSGIPERFSGSNSGNTATLTISRVEAGDEADYYCQVWDSSGDFWVFGGGTKL | 1246 | QVWDSSGDFWV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COVD47_mo6_P1HC_B1-p1369 | 1247 | QLQLQESGPGLVRPSETLSLTCTVSGVSITSGSYSWGWVRQPPGKGLEWIGTINYSESTYYSPSLKSRVTMSVDTSKNQFSLLLRSVTAADTAVYYCATELYYYDRSGFQHWDGFAIWGQGTMVTVSS | 1248 | ATELYYYDRSGFQHWDGF | COVD47_mo6_P1K_B1-p1389 | 1249 | EIVMTQSPATLSVSPGERVSLSCRASQGVSSNLAWYQQKPGQAPRLLIYGASATGIPARISGSGSGTEFTLTISSLQSEDFAIYYCQQYNNWPRRTFGQGTKLEIK | 1250 | QQYNNWPRRT | KAPPA |
| 6.2M | COVD47_mo6_P1HC_B8-p1369 | 1251 | EVQLVESGGGLVQPGGSLRLSCAASGFTFSNNWMSWVRQAPGKGLEWVANIKQDGSEKYYVDSVKGRFTVSRDNAKNSLYLQMSSLRAEDTAVYYCARDARNFDWYFDLWGRGTLVTVSS | 1252 | ARDARNFDWYFDL | COVD47_mo6_P1L_B18-p1409 | 1253 | SYVLTQPPSVSVAPGKTARITCGGDDIATKSVHWYQQKPGQAPVLVIYYDSDRPSGIPERFSGSNSGNTATLTINRVEAGDEADYYCQVWDSTSDHRGYVFGTGTKVTVL | 1254 | QVWDSTSDHRGYV | LAMBDA |
| 6.2M | COVD47_mo6_P1HC_C11-p1369 | 1255 | EVQLVESGGGLIQPGGSLRLSCAASGLLVSRNYMTWVRQAPGKGLEWVSVIYSGGSTFYADSVRGRFTISRDNSKNTLYLQMDSLRAEDTAVYYCARDVGDYYGMDVWGQGTTVTVSS | 1256 | ARDVGDYYGMDV | COVD47_mo6_P1K_C11-p1389 | 1257 | DIQLTQSPSFLFASVGDRVTITCRASQGMSNYLAWYQQKPGKAPNLLIYTASTLQSGVPSRFSGSGFGTEFTFTISSLQPEDFATYYCQLLNSYPQLTFGGGTKVEIK | 1258 | QLLNSYPQLT | KAPPA |
| 6.2M | COVD47_mo6_P1HC_C1-p1369 | 1259 | EVQLVESGGGLIQPGGSLRLSCAASGITVSSNYMSWVRQAPGKGLEWVSVMYAGGSSFYADSVKGRFTISRDNSKNTLYLQMNSLRVEDTAVYYCARDLIALGVDVWGQGTTVTVSS | 1260 | ARDLIALGVDV | COVD47_mo6_P1K_C1-p1389 | 1261 | DIQLTQSPSFLSASVGDRVTITCRASQGISSYLAWYQQKPGKAPKLLIYAASTLQSGVPSRFSGSGSGTEFTLTISSLQPEDFATYYCQLLNSYPMCSFGQGTKLEIK | 1262 | QLLNSYPMCS | KAPPA |
| 6.2M | COVD47_mo6_P1HC_C5-p1369 | 1263 | EVQLVESGGGLVQPGGSLRLSCAASGIIVSRNYMSWVRQAPEKGLEWVSVIYAGGSAFYADSVKGRFTISRDNSKNTLYLQMNGLRAEDTAIYYCARDVARYSDIWGQGTMVTVSS | 1264 | ARDVARYSDI | COVD47_mo6_P1K_C5-p1389 | 1265 | DIQMTQSPSSLSASVGDRVTITCQASQDINNYLNWYQQKPGKAPKLLIYDASNLETGVPSRFRGSRSGTEFTFTISSLQPEDIATYYCQQCDNLPCSFGQGTKLEIK | 1266 | QQCDNLPCS | KAPPA |
| 6.2M | COVD47_mo6_P1HC_C8-p1369 | 1267 | EVQLVQSGAEVKKPGESLRISCRGSGYSFTNHWISWVRQTPGKGLEWMGRIDPSDSYTHYSPSFQGHVTFSADKSISTVYLQWSSLKASDTAMYHCARIAPFHDSGSAYYPTQNYMDVVVGKGTTVTVSS | 1268 | ARIAPFHDSGSAYYPTQNYMDV | COVD47_mo6_P1K_C8-p1389 | 1269 | EIVLTQSPGTLSLSPGERATLSCRASQSVSNSYLAWYQQRPGQAPRLLIFGASSKATGIPDRFSGSGSGTDFTLTISRLEPEDFAVYYCQQYGNLILTFGGGTKVEIK | 1270 | QQYGNLILT | KAPPA |
| 6.2M | COVD47_mo6_P1HC_D12-p1369 | 1271 | EVQLVESGGGLIRPGGSLRLSCAASGFSVSNNYMSWVRQAPGKGLEWVSVIYSGGTTYYADSVKGRFNISRDNSKNTVYLQMNSLRAEDTAVYYCAREGDVEGYYDFWSGYSRDRYYFDYWGQGALVTVSS | 1272 | AREGDVEGYYDFWSGYSRDRYYFDY | COVD47_mo6_P1L_D12-p1409 | 1273 | QSALTQPASVSGSPGQSITISCTGTSSDVGGYNYVSWYQQHPGKAPKLMIYDVSNRPSGVSNRFSGSKSGNTASLTISGLQAEDEADYYCNSYTSNNTRVFGTGTKV | 1274 | NSYTSNNTRV | LAMBDA |
| 6.2M | COVD47_mo6_P1HC_D2-p1369 | 1275 | EVQLVESGGGLVKPGGSLRLSCAASRFTFSSAWMSWVRQAPGKGLEWVGRIKTKTDGETTDYAAPVKGRFTISRDDSKNTLYLQMNSLKTAVYYCSTTNDYGDYSPAYWGQGTLVTVSS | 1276 | STTNDYGDYSPAY | COVD47_mo6_P1K_D2-p1389 | 1277 | DIQMTQSPSSLSASVGDRVTITCRASQSISSYLNWYQQKPGKAPKLLIYAASSLQSGVPSRFSGSGSETAFALTISSLQPEDFATYYCQQSYTTPLTFGGGTKVEIK | 1278 | QQSYTTPLT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 6.2M | COVD47_mo6_P1 HC_D3-p1369 | 1279 | QVQLVESGGGVVQPGRSLRLSCAASGFIFSSFGMHWVRQAPGKGLEWVAVISYDGTDKYYGDSVKGRFIISRDNSKNTLHLQMNSLRTEDTAVYYCTRAPRGYYNSSGHYYIVDYFDYWGQGALVTVSS | 1280 | TRAPRGYYNSSGHYYIVDYFDY | COVD47_mo6_P1 K_D3-p1389 | 1281 | DIQMTQSPSTLSASVGDRVTITCRASQNINNWLAWYQQKPGKVPKVLISESSSLESGVPSRFSGSGSGTEFTLTIISLQPDDFATYYCQQYQSYPLTFGQGTKTEIK | 1282 | QQYQSYPLT | KAPPA |
| 6.2M | COVD47_mo6_P1 HC_D5-p1369 | 1283 | EVQLVESGGGLIQPGGSLRLSCAASGFIVSNNYMSWVRQAPGKGLDWVSVIYSGGTTYYADSVKGRFTISRDNSKNTLYLQMNSLRAEDTAVYYCAREGDVEGYHDSWSGYSRDRYYFDYWGQGTLVTVSS | 1284 | AREGDVEGYHDSWSGYSRDRYYFDY | COVD47_mo6_P1 L_D5-p1409 | 1285 | QSALTQPASVSGSPGQSITISCTGSSSDVGGYNFVSWYQQHPGRAPKLMIYDVSNRPSGVSNRFSGSKSGNTASLTISGLQVEDEADYYCSSYTNNNTRVFGTGTKVTVL | 1286 | SSYTNNNTRV | LAMBDA |
| 6.2M | COVD47_mo6_P1 HC_D6-p1369 | 1287 | EVQLVESGGGLVQPGGSLRLSCTASGFAFSSDDMHWVRQRTGKGLECVSVIGTAGDSYYSDSVKGRFTISRENANNTLYLQMNSLRAGDTAVYYCARGTQSSGWYNGGLKYYYYMDVWGKGTTVTVSS | 1288 | ARGTQSSGWYNGGLKYYYYMDV | COVD47_mo6_P1 K_D6-p1389 | 1289 | DIQMTQSPSSLSASVGDRVTITCRASQSISKYLNWYQQKPGKAPNLLIYAASSLQSGVPSRFSGSGSGTDFTLTISSLQLEDFATYYCQQSYSTPFGTFGGGTKVEIK | 1290 | QQSYSTPFGT | KAPPA |
| 6.2M | COVD47_mo6_P1 HC_D7-p1369 | 1291 | QVQLQESGPGLVKPSETLSLTCTVSGGSVSSGTYYWSWIRQPPGKGLEWIGYIYYSGNTNYNPSLKSRVTISLDTSKNQFSLKLNSVTAADTAVYYCARESGVGGTFDYWGQGTLVTVSS | 1292 | ARESGVGGTFDY | COVD47_mo6_P1 K_D7-p1389 | 1293 | EIVLTQSPGTLSLSPGERATLSCRASQTVSSSYLAWYQQKPGQAPRLLIFGASRRATGIPVRFSGGGSGTDFTLTISRLEAEDFAVYYCQQYGSSPSYTFGQGTKLEIK | 1294 | QQYGSSPSYT | KAPPA |
| 6.2M | COVD47_mo6_P1 HC_E10-p1369 | 1295 | QVQLVQSGAEVKKPGASVKVSCKASGYTFTNYYMHWVRQAPGQGLEWMGIINPDGGSTTYAQKFQGRVTMTRDTSTSTVYMELRSLRSEDTAMYYCARDHDFIPTITRGFDLWGQGTLVTVSS | 1296 | ARDHDFIPTITRGFDL | COVD47_mo6_P1 K_E10-p1389 | 1297 | EIVLTQSPGTLSLSPGERATLSCRASQSVSSTYLAWYQQKPGQAPRLLIYGASSRATGIPDRFSGSGSGTDFTLTISRLEPEDFAVYYCQQSGISLLTFGGGTKVEIK | 1298 | QQSGISLLT | KAPPA |
| 6.2M | COVD47_mo6_P1 HC_E11-p1369 | 1299 | QVQLQQWGAGLLKPSETLSLTCVVYGGSFSAYYWSWIRQPPGKGLEWIGEINHSGSTNYKSSLQSRVTISVDTSKNQFSLKLSSVTAADTAVYYCARETGTYGTFDHWGQGTPVTVSS | 1300 | ARETGTYGTFDH | COVD47_mo6_P1 K_E11-p1389 | 1301 | EIVLTQSPGTLSLSPGERATLSCRASQSVSSTYLAWYQQKPGQAPRLLIYGASSRATGIPDRFSGSGSGTDFTLTISRLEPEDFAVYYCQQYAFSVWTFGQGTKVEI | 1302 | QQYAFSVWT | KAPPA |
| 6.2M | COVD47_mo6_P1 HC_E2-p1369 | 1303 | QVQLQESGPGLVKPSQTLSLTCTVSGGSISSGGYYWSWIRQHPGKGLEWIGYIYYSGGTYYNPSLKSRVTISVDTSKNQFSLRLSSVTAADTAVYYCAREEQQLAPWFDPWGQGTLVTVSS | 1304 | AREEQQLAPWFDP | COVD47_mo6_P1 L_E2-p1409 | 1305 | QSVLTQPPSVSGAPGQRVTISCTGSSSNIGAGYDVHWYQQLPGTAPKLLIYDNINRPSGVPDRFSGSKSGTSASLAITGLQAEDEADYYCQSFDSSLSAYVFAPGTKVTV | 1306 | QSFDSSLSAYV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COVD47_mo6_P1HC_E5-p1369 | 1307 | EVQLVESGGGLVQPGGSQRLSCAASGFTVSSNYMSWIRQAPGKGLEWVSVIYSGGSAYYVDSVKGRFTISRDNSKNTLYLQMNSLRPEDTAVYYCARIANYMDVWGKGTTVTVSS | 1308 | ARIANYMDV | COVD47_mo6_P1K_E5-p1389 | 1309 | EIVMTQSPATLSVSPGERATLSCRASQSVSSHLAWYQQKPGQAPRLLIYGASTRATGIPTRFSGSGSGTEFTLTISSLQSEDFAVYYCQQYNNWPPLTFGGGTKVEIK | 1310 | QQYNNWPPLT | KAPPA |
| 6.2M | COVD47_mo6_P1HC_E8-p1369 | 1311 | EVQLVESGGGLFQPGGSLRLSCAASGFSVRNNYVSWVRQAPGKGLEWVSVIYSGGTTYYADSVKGRFTISRDISENTLYLQMNSLRAEDTAVYYCAREGDVEGLHDFWSGYSRDRYYFDYWGQGTLVTVSS | 1312 | AREGDVEGLHDFWSGYSRDRYYFDY | COVD47_mo6_P1L_E8-p1409 | 1313 | QSVLTQPASVSGSPGQSIIISCTGTSGDIGGYNYVSWYQQHPGKAPKLMIYDVSFRPSGVSNRFSGSKSDNTASLTISGLQAEDEADYYCSSFTGNNTRVFGTGTKVTV | 1314 | SSFTGNNTRV | LAMBDA |
| 6.2M | COVD47_mo6_P1HC_E9-p1369 | 1315 | QVQLQESGPGLVKPSQTLSLTCTVSGGSISSSNYYWSWIRQHPGKGLEWIGYIDYSGGTYYNPSLKSRVTISVDTSKNQFSLKLSSVTAADTAVYYCARVSTTVTTYLVGGFDIWGQGTMVTVSS | 1316 | ARVSTTVTTYLVGGFDI | COVD47_mo6_P1K_E9-p1389 | 1317 | DIQMTQSPSSLSASVGDRVTITCQASQDITNYLNWYQQKPGKAPKLLLYDASNLETGVPSRFSGSGSGTDFTFTISSLQPEDIATYYCQQYDNLPWTFGQGTKVEIK | 1318 | QQYDNLPWT | KAPPA |
| 6.2M | COVD47_mo6_P1HC_F11-p1369 | 1319 | QVQLQQWGAGLLKPSETLSLTCTVYGGSFSGYYWSWIRQPPGKGLEWIGEINHSGTTNYNPSLKSRVTISLDTSKNQFSLKLSSVTAADTAVYYCARVRWLRGETDYWGQGTLVTVSS | 1320 | ARVRWLRGETDY | COVD47_mo6_P1L_F11-p1409 | 1321 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQRVFGGGTKLTVL | 1322 | QSYDSSNQRV | LAMBDA |
| 6.2M | COVD47_mo6_P1HC_F12-p1369 | 1323 | EVQLLESGGGLVQPGGSLRLSCAASGLTFSRYAMSWVRQAPGKGXEWFSGIGGDRDRSXYADSAKGRFTISRDNSKSTLYLQMNSLRTEDTAVYYCAKDVVSWPHYYFDFWGQGTLVTVSS | 1324 | AKDVVSWPHYYFDF | COVD47_mo6_P1K_F12-p1389 | 1325 | DIQMTQSPSSLSASVGDRVTITCQASQDINNYLNWYQQKPGKAPKLLIYDASNLEAGVPSRFSGRGSGTDFTFTISSLQPEDIATYYCQQYDNLLITFGQGTRLDIK | 1326 | QQYDNLLIT | KAPPA |
| 6.2M | COVD47_mo6_P1HC_F1-p1369 | 1327 | EVQLVQSGAEVKKPGESLKISCKGSGYSFISNWIGWVRQMPGKGLEWMGIIYPYDSDTRYSPSFQGQITISADKSISTAYLQWSSLKASDTAMYYCATSIAVSGTYAFDVWGQGTVVTVSS | 1328 | ATSIAVSGTYAFDV | COVD47_mo6_P1L_F1-p1409_R | 1328 | QSVLTQPPSVSGAPGQRVTISCTGSSSNIGAYGVHWYQQFPGTAPKLLIYGDSSRPSGVPDRFSASKSGTSASLAITGLQAEDEADYYCQAYDSGLSGNFVFGTGTKVT | 1330 | QAYDSGLSGNFV | LAMBDA |
| 6.2M | COVD47_mo6_P1HC_F6-p1369 | 1331 | QVQLVESGGGVVQPGRSLRLSCAASGFTFSSYAMYWVRQAPGKGLEWVAVISFDGRNIYYADSVKGRFSISRENSKSTLFLQMNSLRLDDTAMYYCARDCGPAQPPLVEADDYFYFYGMDVVVGQGTTVTVSS | 1332 | ARDCGPAQPPLVEADDYFYFYGMDV | COVD47_mo6_P1L_F6-p1409 | 1333 | SYVLTQPPSVSVSPGQTARITCSGDAFPKQYGYWYQQKPGQAPVLVIYKDSERPSGIPERFSGSSSGTTVTLTISGVQAEDEADYYCQSADSSGTRRVFGGGTKLTVL | 1334 | QSADSSGTRRV | LAMBDA |
| 6.2M | COVD47_mo6_P1HC_F9-p1369 | 1335 | EVQLVQSGAEVKKPGESLRISCKGFGYSFTNYWIGWVRQMPGKGLEWMGIIYPGDSDTKYSPSFQGQVTMSADKSTNTAYLHWSSLKASDTAMYYCARRGYNYGNYYYLDVWGKGTPVTVSS | 1336 | ARRGYNYGNYYYLDV | COVD47_mo6_P1K_F9-p1389 | 1337 | DIQMTQSPSSLSASVGDSVTITCRASQSISTYLNWYQQKPGKAPKLLIYDASSLQSGVPSRFSGSGSGTDFTLTLSSLQPEDFATYYCQQSFSTLALTFGGGTKVEIK | 1338 | QQSFSTLALT | KAPPA |
| 6.2M | COVD47_ | 1339 | QVQLQESGPGLVKPSETLSLTCAVSGGSISSY | 1340 | GVCAGD | COVD47_ | 1341 | DIQMTQSPSSLSASVGDRVTITCQASQ | 1342 | QQ | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | mo6_P1_HC_G10-p1369 | | YWSWIRQPPGKGLEWIGYIDTSGSTNYNPSLKSRVTMSVDTSKNQFSLNVNSVTAADTAVYFCGVCAGDCYAASVFDYRGQGTLVTVSS | | CYAASVFDY | mo6_P1_K_G10-p1389 | | DIIFYLNWYQQKPGKAPKLLIYDASNLKTGVPSRFSGSGSGTDFAFTISSLQPEDIATYYCQQYDNLPLTFGGGTKVEIK | | YDNLPLT | |
| 6.2M | COVD47_mo6_P1_HC_G12-p1369 | 1343 | QVQLVQSGAEVKKPGASVKVSCKASGYNFTSYYMYWVRQAPGQGLEWMGIINPSGGSTSYAQKFQGRVTMTRDTSTSTVYMELSSLRSEDTAVYYCARDRLKQPNPGLRMYNWFAPWGQGTLVTVSS | 1344 | ARDRLKQPNPGLRMYNWFAP | COVD47_mo6_P1_L_G12-p1409 | 1345 | QSVLTQPPSASASLGASVTLTCTLSSGYSNYKVDWYQQRPGKGPRFVMRVGTGGIVGSKGDGIPDRFSVLGSGLNRYLTIKNIQEEDESDYHCGADHGSGSNFVWVFGGGTKLTVL | 1346 | GADHGSGSNFVW | LAMBDA |
| 6.2M | COVD47_mo6_P1_HC_G1-p1369 | 1347 | EVQLLESGGGLVQPGGSLRLSCAASGFSFSDYAMYWVRQAPGKGLEWVSTISGSGANTYYADSVKGRFTISRDNSKNTLSLQMNSLRGEDTAVYYCAIPFTIFGVVPDWCFDFWGRGTLVTVS | 1348 | AIPFTIFGVVPDWCFDF | COVD47_mo6_P1_L_G1-p1409 | 1349 | QSVLTQPRSVSGSPGQSVTISCTGTSSDVGAYNYVSWYQQHPGKAPKLMIYNVSERPSGVPDRFSGSKSGNTASLTISGLQADDEADYYCCSYAGNFWVFGTGTKLTVL | 1350 | CSYAGNFWV | LAMBDA |
| 6.2M | COVD47_mo6_P1_HC_G4-p1369 | 1351 | EVQLVESGGGLIQPGGSLRLSCAASGFTVSNNYMSWVRQAPGKGLEWVSVIYSGGSTYDADSVKGRFTISRDNSKNTLYLQMNSLSAEDTAVYYCAREGDVEGYYDFWSGYSRDRYYFDYWGQGTLVTVSS | 1352 | AREGDVEGYYDFWSGYSRDRYYFDY | COVD47_mo6_P1_L_G4-p1409 | 1353 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSARVFGTGTKVTVL | 1354 | SSYTSSSARV | LAMBDA |
| 6.2M | COVD47_mo6_P1_HC_G5-p1369 | 1355 | EVQLVESGGDLVQPGGSLRLSCAASGFTFTTYSMSWVRQAPGKGLEWISYINSGSANIHYADSVKGRFTVSRDNAKNSLYLQMNSLRDEDTAVYYCARGDCLSSSCYSLDYWGQGALVTVSS | 1356 | ARGDCLSSSCYSLDY | COVD47_mo6_P1_K_G5-p1389 | 1357 | DIQMTQSPSSLSASVGDRVTITCRASQSITSYLSWYLQKPGEAPKLLIYAASILQSGVPSRFGGNGSGTDFTLTISSLQPEDFATFYCQQTYRSPLTFGGGTRVEIK | 1358 | QQTYRSPLT | KAPPA |
| 6.2M | COVD47_mo6_P1_HC_G7-p1369 | 1359 | QVQLVESGGGVVQPGRSLRLSCAASGFSFRIFGMNWVRQAPGKGLDWVAGISHDGSDKYFADSVKGRFTISRDNSKNTLYLQMNSLRADDTAVYYCARDMEVDYYDRSGHYHVFHAFDIWGQGTVVTVSS | 1360 | ARDMEVDYYDRSGHYHVFHAFDI | COVD47_mo6_P1_K_G7-p1389 | 1361 | DIVMTQSPDSLAVSLGARATINCKSSQSILYSSDNKSSLAWYQQKPGHPPKLLIYWASTRESGVPDRFSGSESGTDFTLTISNLQGEDVAVYYCQQYYSIPRSFGQGTKLEIK | 1362 | QQYYSIPRS | KAPPA |
| 6.2M | COVD47_mo6_P1_HC_G8-p1369 | 1363 | EVQLVESGGGLVKPGGSLRLTCAASGFTFSTYSMNWVRQAPGKGLEWVSSISSSSSYIYYADSVKGRFTISRDNAKNSLYLQMNSLRAEDTAVYYCARERGYYGGKTPPFLGGQGTLVTVSS | 1364 | ARERGYYGGKTPPFL | COVD47_mo6_P1_L_G8-p1409 | 1365 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNYWVFGGGTKLTVL | 1366 | QSYDSSNYWV | LAMBDA |
| 6.2M | COVD47_mo6_P1_HC_H10-p1369 | 1367 | EVQLVESGGNLVQPGGSLRLSCSASGFTFSNYAIHWVRQAPGKGLEYVSLVSSNGDTTYYAGSVKGRFTISRDNSKNTLYLQMSSLRAEDTAVYYCVRGDMVAGYFDYWGQGTLVTVSS | 1368 | VRGDMVAGYFDY | COVD47_mo6_P1_L_H10-p1409 | 1369 | SYVLTQPPSVSVAPGQTARITCGGDEIGSKNVHWYQQKPGQAPVLVVYDDSDRPSGIPERFSGSNSANTASLTISRLESGDEADYYCQVWDSSSDHHWVFGGGTKLTVL | 1370 | QVWDSSSDHHWV | LAMBDA |
| 6.2M | COVD47_mo6_P1 | 1371 | QVQLVQSGAEVKKPGASVKVSCKASGYIFSRYDMHWVRQAPGQRLEWMGWINAGNGNTR | 1372 | ARDPSYCSDERC | COVD47_mo6_P1 | 1373 | SYVLTQPPSVSVAPGQTARIACGGDTIGSKNVHWYQQKPGQAPVLVVYDD | 1374 | QVWD | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | HC_H11-p1369 | | YSQKFQGRVTITRDTSATTVYMDLTSLRSEDTAVYYCARDPSYCSDERCSRRDWFDPWGQGTLVTVSS | | SRRDWFDP | L_H11-p1409 | | RPSGIPERFSGSNSGNTATLSISRVEAGDEADYFCQVWDSGSDHFWVFGGRDQADRP | | SGSDHFWV | |
| 6.2M | COVD47_mo6_P1HC_H4-p1369 | 1375 | QVQLQESGPGLVKPSQTLSLTCTVSGGSISSGGYYWSWIRQHPGKGLEWIGYIYYSGSTYYNPSLKSRVSISVDTSKNQFSLKLSSVTAADTAVYYCARGVGFGELGFDPWGQGTLVTVSS | 1376 | ARGVGFGELGFDP | COVD47_mo6_P1K_H4-p389 | 1377 | DIQLTQSPSFLSASVGDRVTITCRASQGISSYLAWYQQKPGKAPKLLIYGASTLQSGVPSRFSGSGSGTEFTLTISSLQPEDFATYYCQQLNSYPPITFGQGTRLEIK | 1378 | QQLNSYPPIT | KAPPA |
| 6.2M | COVD47_mo6_P1HC_H6-p1369 | 1379 | EVQLVESGGGLVKPGGSLTLSCAASGFSFFSYNMNWVRQAPGKGLEWVSSIGSTTKYIYYADSVKGRFTISRDNAKNLLYLQMNSLRAEDTAVYYCVRERYGDNWGQGTLVTVSS | 1380 | VRERYGDN | COVD47_mo6_P1L_H6-p1409 | 1381 | QSVLTQSPSASASLGASVKLTCTLSSGHSSYAIAWHQQQPEKGPRFLMSLNSDGSHSKGDGIPDRFSGSSSGPERYLTISSLQSEDEADYYCQTWGLWVFGGGTKLTVL | 1382 | QTWGLWV | LAMBDA |
| 6.2M | COVD47_mo6_P2HC_A10-p1369 | 1383 | QVQLQESGPGLVRPSQILSLTCTVSGGSISSGGYYWSWIRQHPGKGLEWIGYIYYSGSTYYNPSLKSRVSISVDTSKNQFSLKLSSVTAADTAVFYCATFTVAGHFLFWGQGTLVTVSS | 1384 | ATFTVAGHFLF | COVD47_mo6_P2K_A10-p1389 | 1385 | DIQMTQSPSSLSASVGDRVTITCQASQDSTNHLNWYQQKPGKAPKLLIYDASNLETGVPSRFSGSGSGTDFTFTISSLQPEDIATYYCQHYDDLPSFGPGTKVDFK | 1386 | QHYDDLPS | KAPPA |
| 6.2M | COVD47_mo6_P2HC_A11-p1369 | 1387 | QVQLVQSGAEVKRPGASVKLSCKASGYIFTDYSIHWVRQAPGQGLEWMGWVNPNSGGGNSAQKFMDWVTMARDTSITTVYMELSRLRSDDTAVYYCARGPLFHKLVYDSWSGYHDGFDIWGQGTMVTVSS | 1388 | ARGPLFHKLVYDSWSGYHDGFDI | COVD47_mo6_P2L_A11-p1409 | 1389 | QSVLTQPASVSGSPGQSITISCTGTSSDVGAYKFVSWYQQHPGKAPQLIIYEVSNRPSGVSNRFSGSKSGNTASLTISGLQAEDEADYYCSSYTNASTWVFGGGTELTVL | 1390 | SSYTNASTWV | LAMBDA |
| 6.2M | COVD47_mo6_P2HC_A3-p1369 | 1391 | EVQLVESGGGLIQPGGSLRLSCAASGITVSSNYMSWVRQAPGKGLEWVSIIYAGGSSFYADSVKGRFTISRDNSKNTLYLQMNSLRAEDTAVYYCARDLIALGVDVWGQGTTVTVSS | 1392 | ARDLIALGVDV | COVD47_mo6_P2K_A3-p1389 | 1393 | DIQLTQSPSFLSASVGDRVTITCRASQGISTYLAWYQQKPGKAPKLLIYAASTLQSGVPSRFSGSGSGTEFTLTISSLQPEDFATYYCQLLDSYPMCSFGQGTKLEIK | 1394 | QLLDSYPMCS | KAPPA |
| 6.2M | COVD47_mo6_P2HC_A4-p1369 | 1395 | QVQLVQSGAEVKKPGASVKVSCKASGYTFTDYYIHCVRQAPGQGLEWMGMINPGGGSTSYAQKFQGRVTMTRDTSTTTVYMEMSSLRSEDTAVYYCVRGENSFDSSGNEQYNNYAMDVVVGQGTTVTVSS | 1396 | VRGENSFDSSGNEQYNNYAMDV | COVD47_mo6_P2K_A4-p1389 | 1397 | DIQMTQSPSSLSASVGDRVTITCRASQGISNYLAWFQQKPGKAPKSLIYAASNLQSGVPSRFSGSGSGTDFTLTISSLQPEDFATYYCQQYNSYPPTFGGGTKVEIK | 1398 | QQYNSYPPT | KAPPA |
| 6.2M | COVD47_mo6_P2HC_A7-p1369 | 1399 | QVQLQESGPGLVKPSETLSLTCAVSGGSISSYYWSWIRQPPGKGLEWIGYIDTSGSTNYNPSLKSRVTLSVDTSKNQFSLNLSSVTAADTAVYFCGVCAGDCYSASVFDYWGQGTLVTVSS | 1400 | GVCAGDCYSASVFDY | COVD47_mo6_P2K_A7-p1389 | 1401 | DIQMTQSPSSLSASVGDRVTITCQASQDIIFYLNWYQQKPGKAPKLLIYDASNLKTGVPSRFSGSGSGTDFAFTISSLQPEDIATYYCQQYDNLPLTFGGGTKVEIK | 1402 | QQYDNLPLT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COVD47_mo6_P2HC_B11-p1369 | 1403 | QVQLVESGGGVVQPGRSLRLSCAASGFTFGHYGMHWVRQAPGKGLEWVAVILYDGSNTYYADSVKGRFTISRDNSKNTLYLQMNSLRTEDAVYYCAKAPSPYCGGGDCYSSGFDPWGQGSLVTVSS | 1404 | AKAPSPYCGGGDCYSSGFDP | COVD47_mo6_P2K_B11-p1389 | 1405 | DIQMTQSPSSLSASVGDRVTITCQASQDITDYLNWYQQKPGKAPKLLIYDASNLETGVPSRFSGSGTGTDFSFTISSLQPEDFATYYCQQYANLPLTFGGGTKVEIK | 1406 | QQYANLPLT | KAPPA |
| 6.2M | COVD47_mo6_P2HC_B12-p1369 | 1407 | QLQLQESGPGLVKPSETLSLTCTVSSGSISSSSYYWGWIRQPPGKGLEWIGSIFSSGGAHYNPSLKSRVTISVDTSRNQFSLNLTSVTAADTAVYYCARHPAVAGDEYFQHWGQGTLVTVSS | 1408 | ARHPAVAGDEYFQH | COVD47_mo6_P2L_B12-p1409 | 1409 | SYVLTQPPSVSVAPGKTASITCGGDNIGSKNVHWYQQKPGQAPVLVIYYDSDRPSGIPERFSGSNSGNTATLTISRVEAGDEADYYCQVWDSTTDLPHYVFGAGTRVT | 1410 | QVWDSTTDLPHYV | LAMBDA |
| 6.2M | COVD47_mo6_P2HC_B3-p1369 | 1411 | EVQLVQSGAEVTKTGESLKISCKSSGYSFISNWIGWVRQMPGKGLEWVAIIYPGDSDTRYSPSFQGQVTISADTSISTAYLQWSSLKASDTAMYYCARLLGGTYAADFDYWGQGTLVTVSS | 1412 | ARLLGGTYAADFDY | COVD47_mo6_P2L_B3-p1409_R | 1413 | QSVLTQPPSASGSPGQSVTISCTGTSSDVGGHNYVSWYRHHPGKAPKLMIYEVSSGVPDRFSGSKSGNTASLTVSGLQAEDEADYYCGSYAGSHKWVFGGGTKLTVL | 1414 | GSYAGSHKWV | LAMBDA |
| 6.2M | COVD47_mo6_P2HC_C10-p1369 | 1415 | EVQLVQSGAEVKKPGDSLKISCKASGYSFTRYWIGWVRQMPGKGLDWMGIIYPGDSDTRYSSSFQGQVTISADKSISTAYLQWSSLKASDTSLYYCVRRASSTNFEFWGQGTLVTVSS | 1416 | VRRASSTNFEF | COVD47_mo6_P2L_C10-p1409 | 1417 | SYVLTQPPSVSVAPGQTATITCGGNNIGSKTVHWYQQKPGQAPVVVVYDDSDRPSGIPERFSGSKSGSTATLTITRVEAGDEADYYCQVWDSTSDHYVFGTGTKVAVI | 1418 | QVWDSTSDHYV | LAMBDA |
| 6.2M | COVD47_mo6_P2HC_C11-p1369 | 1419 | EVQLVQSGAEVKKPGESLKISCKGSGYTFTKYWIAWVRQMPGKGLEWMGFIYPADSDTRYSPSFEGQVTISADKSTSTAYLQWSSLKASDTAIYYCARPGGKGEHYHGPIDYWGQGTLVTVSS | 1420 | ARPGGKGEHYHGPIDY | COVD47_mo6_P2K_C11-p1389 | 1421 | DIQMTQSPSSLSASVGDRVTITCQASQDISDYLNWYQQKPGKAPKLLIYDASNLETGVPSRFSGSGSGTDFTFTISSLQPKDIATYYCQQYNNFPPSFGQGTKLEIK | 1422 | QQYNNFPPS | KAPPA |
| 6.2M | COVD47_mo6_P2HC_C4-p1369 | 1423 | QVQLVESGGGVVQPGRSLRLSCAASGFTFRTYAMHWVRQAPGKGLEWVAVILSDGNNKYYADSVKGRFTISRDNSKNTLYLQMNSLRAEDTAIFYCAREQEANYYDISGYYHWGESLGYWGQGTLVTVPS | 1424 | AREQEANYYDISGYYHWGESLGY | COVD47_mo6_P2K_C4-p1389 | 1425 | DIQLTQSPSFLSASVGDRVTITCRASQGISSYLAWYQQKPGKAPKFLIYGASTLQSGVPSRFSGSGSGTEFTLTISSLQPEDFASYYCQKVNSYPPGLTFGGGTKVEIK | 1426 | QKVNSYPPGLT | KAPPA |
| 6.2M | COVD47_mo6_P2HC_C9-p1369 | 1427 | QVQLQESGPGLVKPSQTLSLSCTVSGGSISSGGYYWSWIRQHPGKGLEWIGYIYYSGSTYYNPSLKSRITMSVDTSKNQFSLKLSSVTAADTAVYYCARDYVTGRGAFDIWGQGTMVIVSS | 1428 | ARDYVTGRGAFDI | COVD47_mo6_P2K_C9-p1389 | 1429 | DIQMTQSPSSLSASVGDRVTITCQASRDISNYLNWYQQRPGEAPKLLIYDASNLETGVPSRFSGSGSGTDFTFTISSLQPEDIATYYCQQYDTFPCTFGQGTKLEI | 1430 | QQYDTFPCT | KAPPA |
| 6.2M | COVD47_mo6_P2HC_D11-p1369 | 1431 | EVQLLESGGGLVQPGGSLRLSCVVSGFTFKNYAMSWVRQAPGKGLEWVSGINGYNDNTYYAASVKGRFTISRDNSKNTLYLQMNSLRLEDTAVYFCAKRGYHYDSSAYFSPYYFDYWGQGTLVTVSS | 1432 | AKRGYHYDSSAYFSPYYFDY | COVD47_mo6_P2K_D11-p1389 | 1433 | DIQMTQSPSSLFASIGDRVTITCQGSQDISNHLNWYQQKPGKAPKLLIYDASNLETGVPSRFSGNGSGTDFTFTIASLQPEDIATYYCQQYDTLPPFFGGGTKVEIK | 1434 | QQYDTLPPF | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 6.2M | COVD47_mo6_P2HC_D5-p1369 | 1435 | QVQLVQSGAEVKKPGSSVKVSCKASGDTYNTYAISWVRQAPGQGLEYMGGITLVFGTTNYAQKFQGRLTITTDESTTTFYMDLISLRSEDTAIYYCARAGVAYGDYVPDYWGQGTLVIVSS | 1436 | ARAGVAYGDYVPDY | COVD47_mo6_P2K_D5-p1389 | 1437 | EIVLTQSPGTLSLSPGERATLSCRASQSISSNYLAWYQQNPGQAPRLLIYGASSRATGIPDRFSGSGSGTDFTLTISRLEPEDFAVYYCQQYGNSPPWTFGQGTKVEIK | 1438 | QQYGNSPPWT | KAPPA |
| 6.2M | COVD47_mo6_P2HC_D6-p1369 | 1439 | QVQLQESGPGLVKPSETLSLTCTVSGDSISTYFWAWIRQPPGRGLECIGSFFPSGSTYYNPSLKSRVTISVDTSKNQFSLKLNSVTAADTAVYYCARLKQQLVGFGWFDPWGQGSLVTVSS | 1440 | ARLKQQLVGFGWFDP | COVD47_mo6_P2L_D6-p1409 | 1441 | QSVLTQPPSVSGAPGQRVTISCTGSISNIGADYEVHWYVQFPGTAPKVLIYANTNRPSGVPERFSASKSGTSASLAITGLQAEDEADYYCQSYDHRLHWVFGGGTKLTVL | 1442 | QSYDHRLHWV | LAMBDA |
| 6.2M | COVD47_mo6_P2HC_D9-p1369 | 1443 | EVQLVESGGGLVQPGGSLRLSCAASGFTFSSYCMNWVRQAPGKGLEWVSYISSSSNIIYYADSVKGRFTISRDNAKNSLYLQMNSLRAEDTAVYYCARDLRTYNDFWSGHGPYFFDYWGQGTLVTVSS | 1444 | ARDLRTYNDFWSGHGPYFFDY | COVD47_mo6_P2K_D9-p1389 | 1445 | DIQMTQSPSTLSASVGDRVTITCRASQSISSWLAWYQQKPGKAPKLLIYKASSLESGVPSRFSGSGSETEFTLTISSLQPDDFATYYCQQYNHYSYTFGQGTKLEIK | 1446 | QQYNHYSYT | KAPPA |
| 6.2M | COVD47_mo6_P2HC_E10-p1369 | 1447 | QVQLQESGPGLVKPSETLSLTCTVSGGSISTFYWNWIRQPPGKGLEWIGHIYYSGSTNYNPSLKSRVTISLDTSENQFSLRMSSVTGADTAVYYCARGVVQLNYDYGMDVWGQGTTVTVSS | 1448 | ARGVVQLNYDYGMDV | COVD47_mo6_P2K_D9-p1389 | 1449 | SYVLTQPPSVSVAPGKTARITCGGDNIGSKSVHWYQQRPGQAPVLVIYYDSDRPSGIPERFSGSNSGNTATLTISRVEAGDEADYYCQVWDNGSDHPVLFGGGTKL | 1450 | QVWDNGSDHPVL | LAMBDA |
| 6.2M | COVD47_mo6_P2HC_E11-p1369 | 1451 | QVQLVESGGGVVQPGRSLRLSCVASGFSFSTYGMHWVRQAPGKGLEWVALIWSDGSNKYYGDAAEGRFTISRDNSNNTLYLQMNNLRAEDTALYYCARDHSSSSFVYYYYMDVWGKGTTVTVSS | 1452 | ARDHSSSSFVYYYYMDV | COVD47_mo6_P2L_E11-p1409 | 1453 | QSVLTQPRSVSGSPGQSVTISCTGTSSDIGGYNYVSWYQQHPDKAPKFIIFDVSKRPSGVPDRFSGSKSGNTASLTISGLQAEDEADYYCCSYAGPYPYVFGTGTKVTV | 1454 | CSYAGPYPYV | LAMBDA |
| 6.2M | COVD47_mo6_P2HC_E12-p1369 | 1455 | EVQLVESGGGLVQPGGSLRLSCAASGFTFSSHSMSWVRQAPVKGLEWVSYISGRSSTIYYADSVKGRFTISRDNAKNSLYLQMNSLRDEDTAVYYCARAMAPTYNDFYSGPDVFDIWGQGTMVTVSS | 1456 | ARAMAPTYNDFYSGPDVFDI | COVD47_mo6_P2K_E12-p1389 | 1457 | DIQMTQSPSTLSASVGDRVTITCRASQTISSWLAWYQQKPGKAPKVLIYKASSLETGVPSRFSGSGSGTEFTLTIINLQPDDFATYYCQQYNSYSVTFGGGTKVEIK | 1458 | QQYNSYSVT | KAPPA |
| 6.2M | COVD47_mo6_P2HC_E1-p1369 | 1459 | QVQLQESGPGLVKPSGTLSLTCAVSGASITSSNWWSWVRQPPGEGLEWIGEIYHNGN1EYNPSLKSRVTISVDKSKNQFSLKLSSVTAADTAVYYCARVSGMFDYWGQGSLVTVSS | 1460 | ARVSGMFDY | COVD47_mo6_P2K_E1-p1389 | 1461 | DIQMTQSPSSLSASVGDRVTITCRASQGISNSLAWYQQKPGKAPKLLLYAASTLESGVPSRFSGSGSGTEYTLTISSLQPEDFATYYCQQYYSIRTFGQGTRVDIK | 1462 | QQYYSIRT | KAPPA |
| 6.2M | COVD47_mo6_P2HC_E3-p1369 | 1463 | QVQLVESGGGVVQPGRSLRLSCAASGFTFSSYGMHWVRQAPGKGLEWVATIWYDGSEKYYADSVKGRFTISRDNSKNTLYLQMNSLRAEDTAVFYCARDVTPYYYGSGSYYKLGETTHPDYWGQGTLVTVSS | 1464 | ARDVTPYYYGSGSYYKLGETTHPDY | COVD47_mo6_P2K_E3-p1389 | 1465 | DIQMTQSPSTLSASVGDRVTITCRASQSIGVWLAWYQQKPGKAPKLLIYKASSLETGVPSRFSGSGSGTEFTLTINSLQPDDFATYHCQQYNSFPLTFGQGTKLEI | 1466 | QQYNSFPLT | KAPPA |
| 6.2M | COVD47_mo6_P2 | 1467 | EVQLVESGGGLIQAGGSLRLSCAASGFGVRNNYMSWVRQAPGKGLEWVSVIYSGGTTYYAD | 1468 | AREGDVEGFSDL | COVD47_mo6_P2 | 1469 | QSVLTQPASVSGSPGQSITFSCTGTSSDVGGYNYVSWYQQYPGKAPKLLIYDVT | 1470 | SSFTSS | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| | HC_E4-p1369 | | SVKGRFTISRDNSKNTVFLQMNSLRAEDTAVYYCAREGDVEGFSDLWSGYSRDRYYFDYWGQGTLVTVSS | WSGYSRDRYYFDY | L_E4-p1409 | | NRPSGVSDRFSGSKSGNTASLTISGLQAEDEADYYCSSFTSSNTRVFGTGTKVTVL | | NTRV | |
| 6.2M | COVD47_mo6_P2_HC_E5-p1369 | 1471 | QVQLVQSGAEAKKPGASVKVSCKTSGYTFTNYFMHWVRQAPGQGPEWMGIIDSSDGGASYAQKFQGRVTMTRDTSTSTVYMELRSLKFEDTAVYYCARASTSTTSWSDALSLGSWGQGTLVTVSS | 1472 ARASTSTTSWSDALSLGS | COVD47_mo6_P2_L_E5-p1409 | 1473 | QSVLTQPPSVSGAPGQRVTISCTGSSSNIGGGSVVHWYQQLPGTAPKLLIYANSNRPSGVPDRFSGSKSGTSASLAIAGLQAEDEADYYCQSWDNGLSASGVVFGGGTKLTVL | 1474 | QSWDNGLSASGVV | LAMBDA |
| 6.2M | COVD47_mo6_P2_HC_E7-p1369 | 1475 | QVQLQESGPGLVKPSGTLSLTCAVSGGSISNNNWWSWVRQPPGKGLEWIGEIFHSGTITYNPSSRVTISVDKSKNQFSLKLKSVTAADTAVYYCARAWIQPHNWFDPWGQGILVTVSS | 1476 ARAWIQPHNWFDP | COVD47_mo6_P2_K_E5-p1389 | 1477 | EIVLTQSPGTLSLSPGERATLSCRASQTVSSSYLAWYQQKPGQAPRLLIYGASSRATGIPDRFSGSGSGTDFTLTISRLEPEDFAVYYCQQYGSSPRTFGQGTKLEIK | 1478 | QQYGSSPRT | KAPPA |
| 6.2M | COVD47_mo6_P2_HC_F10-p1369 | 1479 | QVQLVESGGGVVQPGRSLRLSCEASGFTFSHYGIHWVRQAPGKGLEWVAVMSYDGSDEYYADSVKGRFTISRDNSRNTVYLQMNSLRTDDTAVYYCAKVGAPYYYYYYGMDVWGQGTPVTVSS | 1480 AKVGAPYYYYYYGMDV | COVD47_mo6_P2_L_F10-p1409 | 1481 | QSVLTQPASVSGSPGQSITISCTGTSVGAYNYVSWYQQYPGKAPKLMIYEVSDRPSGVSNRFSGSKSGNTASLTISGLQAEDEADYYCSSYISSTTSWVFGGGTKL | 1482 | SSYISSTTSWV | LAMBDA |
| 6.2M | COVD47_mo6_P2_HC_F10-p1369 | 1483 | QVQLVQSGAEVKKPGASIKVSCKASGYTFTDYSMHWVRQAPGQGLEWMGWINPNSGGTKYAQKFQGWVTMTRDMSITTVYMELTRLRSDATAVFYCARGPLFHKLVYDSWTGYHDGFDIWGQGTMVTVSS | 1484 ARGPLFHKLVYDSWTGYHDGFDI | COVD47_mo6_P2_L_F11-p1409 | 1485 | QSVLTQPASVSGSPGQSITISCTGTSSDVGGYNYVSWYQHYPGKAPKLMIYEVTHRPSGVSNRFSGSKSGNTASLTISGLQAEDEADYYCSSSTNSSTWVFGGGTKMTVL | 1486 | SSSTNSSTWV | LAMBDA |
| 6.2M | COVD47_mo6_P2_HC_F2-p1369 | 1487 | QVQLVESGGGVVQPGRSLRLSCAASGFAFSNYGMHWVRQAPGKGLDWVAVIWYDGSNKYYADSVKGRFTISRDNSKNTLYLQMNSLRAENTAVYYCARDPMIVVVEMDYWGQGTLVTVSS | 1488 ARDPMIVVVEMDY | COVD47_mo6_P2_K_F2-p1389 | 1489 | DVVMTQSPLSLPVTLGQPASISCRSGQSLVHSDGNTYLNWFQQRPGQSPRRLIYRVSNRDSGVPDRFSGSGSGTDFTLKISRVEADDVGVYYCMQGTHWPYTFGQGTKLEIK | 1490 | MQGTHWPYT | KAPPA |
| 6.2M | COVD47_mo6_P2_HC_F5-p1369 | 1491 | QVQLVESGGGVVQTGRSVRLSCAASGFTFTNYGMHWVRQAPGKGLEWVAVIWYDGSNKYYADSVRGRFTISRDNSKNTLFLQMNSLRAEDTAVYYCARDFIPEDLIVVDVTGGAYGMDVWGQGTTVTVSS | 1492 ARDFIPEDLIVVDVTGGAYGMDV | COVD47_mo6_P2_L_F5-p1409 | 1493 | QSVLTQPASVSGSPGQSITISCTGSSSDIGGYNFVSWYQQHPGKAPKLMIYDVSNRPPGVSYRFSGSKSGNTASLTISGLQAEDEADYYCNSYTGSTTPLFGGGTKLTVL | 1494 | NSYTGSTTPL | LAMBDA |
| 6.2M | COVD47_mo6_P2_HC_F6-p1369 | 1495 | EVQLVESGGTLVQPGGSLRLSCSASGFTFSTYTMHWVRQAPGKGLEYVSGISITGDIAYYADSVKGRFTISRDNSKNTLYFQMSSLRPEDTALYYCVKDRDSSTWYDAFDIWGQGTMVTVSS | 1496 VKDRDSSTWYDAFDI | COVD47_mo6_P2_K_F6-p1389 | 1497 | DIQMTQSPSSLSASVGDRVTITCRARQSITSYLNWYQQKPGKAPKLLIYAASSLQSGVPSRFSGSGSGTDFTLTISSLQPEDFATYYCQQSYSTPWTFGQGTKVEIK | 1498 | QQSYSTPWT | KAPPA |
| 6.2M | COVD47_mo6_P2_HC_ | 1499 | QLQLQESGPGLVKPSETLSLTCTVSGGSMSSSNHYWGWIRQPPGKGLEWIGSIYYSGSTFHNPSLMSRVTISVDTSKSQFSLKLTSVTAADTAVY | 1500 ARHDLPPYSSGWSYFDN | COVD47_mo6_P2_L_ | 1501 | QSVLTQPPSVSAAPGQKVTISCSGSTSNIGSNSVSWYQQLPGTAPKLLIYDNNKRPSGIPDRFSGSKSGTSATLGITGLQTGD | 1502 | GSWDSSL | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | F7-p1369 | | YCARHDLPPYSSGWSYFDNWGQGTLVTVSS | | | F7-p1409 | | EADYYCGSWDSSLREVFGTGTKVSVL | | REV | |
| 6.2M | COVD47_mo6_P2HC_G3-p1369 | 1503 | QVQLVQSGAGVRKPGASVKVSCKASGYTFTGYYMHWVRQAPGQGLEWMGWINPNNGDTGYAQKFQGWVTMTRDTSISTAYMELSRLTSADTAVYYCVRGAVVYGTAGWFDPWGQGTLVTVSS | 1504 | VRGAVVYGTAGWFDP | COVD47_mo6_P2L_G3-p1409 | 1505 | SYVLTQPPSVSVAPGQTARITCGADNIGSKNVHWYQQKAAQAPVLVVYDDSDRPSGIPERFSGSNSGNTATLTISRVEAGDEADYYCQVWDSYSNWVFGGGAKLT | 1506 | QVWDSYSNWV | LAMBDA |
| 6.2M | COVD47_mo6_P2HC_G6-p1369 | 1507 | EVQLVQSGAEVKKPGESLKISCKGPAYSFTNYWIGWVRQMPGKGLEWMGVIYPGDSETRYSPSFQGQVTISADKSISTAYLQWNSLSASDTAIYYCARQFCGGHCPFDFWGQGTLVTVSS | 1508 | ARQFCGGHCPFDF | COVD47_mo6_P2L_G6-p1409 | 1509 | NFMLTQPHSVSESPGKTVTISCTGNSGSIASNYVQWYQQRPDSAPTTVIFEDDQRPSGVPDRFSGSIDSSSNSASLTISGLR1EDEADYYCQSYDSNNLWVFGGGTKLT | 1510 | QSYDSNNLWV | LAMBDA |
| 6.2M | COVD47_mo6_P2HC_H10-p1369 | 1511 | EVQLLESGGDLVQPGGSLRLSCAASGFTFSNYAMSWVRQAPGKGLEWVSAISGSGGNTYYADSVKGRFTISRDNSKNTLYLQMNSLRAEDTAVYYCAKAVHYGGNSDRRFSEPSAPFDYWGQGTLVTVSS | 1512 | AKAVHYGGNSDRRFSEPSAPFDY | COVD47_mo6_P2L_H10-p1409 | 1513 | QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSSTPYVFGTGTKVTVL | 1514 | CSYAGSSTPYV | LAMBDA |
| 6.2M | COVD47_mo6_P2HC_H11-p1369 | 1515 | QLQLQESGPGLVKPSETLSLTCSVSGGSIIRSSYYWGWIRQPPGKGLEWIGSIYYSGSTYYNPSLKSRVTISVDTSKNQFSLKLSSVTAADTAVYYCARRRYLDWSSPFEYWGQGTLVTVSS | 1516 | ARRRYLDWSSPFEY | COVD47_mo6_P2L_H11-p1409 | 1517 | SYVLTQPPSVSVAPGQTARITCGGNNIGSKRVHWYQQKPGQAPVLVVYDDSDRPSGIPERFSGSNSGNTATLTISRVEAGDEADYSCQVWDSSSDLQVFGGGTKLT | 1518 | QVWDSSSDLQV | LAMBDA |
| 6.2M | COVD47_mo6_P2HC_H6-p1369 | 1519 | QVQLQQWGAGLLKPSETLSLTCAVYGGSFSDYYWSWIRQPPGKGLEWIGENNHSGKTNYNPSSRVTISVDTSKNQFSLKLTSVTAADTAVYYCARESGTYATFDYWGQGTLVTVSS | 1520 | ARESGTYATFDY | COVD47_mo6_P2K_H6-p1389 | 1521 | EIVLTQSPGTLSLSPGERVTLSCRASQNVSSAYLAWYQQKPGQAPRLLIYGASSRATGIPDRFSGSGSGTDFTLTISRLEPEDFAVYYCQQYGYTIWTFGQGTKVEIK | 1522 | QQYGYTIWT | KAPPA |
| 6.2M | COVD47_mo6_P2HC_H9-p1369 | 1523 | EVQLVQSGAEVKKPGESLKISCKGSGYSFTSYWIGWVRQMPGRGLEWMGIIYPGDSDTKYSPSFQGQVTISADKSISTAYLQWSSLKASDTAMYYCARRNLITADGPFYYYGMDVWGQGTTVTVSS | 1524 | ARRNLITADGPFYYYGMDV | COVD47_mo6_P2K_H9-p1389 | 1525 | AIQLTQSPSSLSASVGDRVTITCRASQGISGALAWYQQKPGNAPDLLIYDASSGVPSRFSGSGSGTDFTLTISSLQPEDFATYYCQQFNSYSSTFGQGTRLEIK | 1526 | QQFNSYSST | KAPPA |
| 1.3M | COV047_P3_IgG_10-P1369 | 1527 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVFYCARDRGGHDFWSGYGFYYYYGMDVWGQGTTVTVSS | 1528 | ARDRGGHDFWSGYGFYYYYGMDV | COV047_P3_Kappa_10-P1389 | 1529 | DIQMTQSPSSLSASVGDRVTITCRASQGISNYLAWYQQRPGKVPKLLIFAASTLQSGVPSRFSGSGSGTDFTLTISSLQPEDVATYYCQKYNSAPRTFGQGTKVEIK | 1530 | QKYNSAPRT | KAPPA |
| 1.3M | COV047_P3_IgG_14-P1369 | 1531 | EVQLVETGGGLIQPGGSLRLSCAASEFTVSSNYMSWVRQAPGKGLEWVSLIYSGGSTYYADSVKGRFTISRDNSKNTLYLQMNSLRAEDTAVYYCARVLPFGDYFDYWGQGTLVTVSS | 1532 | ARVLPFGDYFDY | COV047_P3_Lambda_14-P1409 | 1533 | QSVLTQPPSVSGAPGQRVTISCTGSSSNIGAGYDVHWCQQLPGTAPKLLIYGYSNRPSGVPDRFSGSKSGTSASLAITGLQAEDEADYYCQSYDINLSAWVFGGGTRLTXL | 1534 | QSYDINLSAWV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV047_P3_IgG_16-P1369 | 1535 | EVQLVESGGGLVQPGGSLRLSCAASGFSVSTKYMTWVRQAPGKGLEWVSVLYSGGSDYYADSVKGRFTISRDNSKNALYLQMNSLRVEDTGVYYCARDSSEVRDHPGHPGRSVGAFDIWGQGTMVTVSS | 1536 | ARDSSEVRDHPGHPGRSVGAFDI | COV047_P3_Lambda_16-P1409 | 1537 | QSVLTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL | 1538 | CSYAGASTFV | LAMBDA |
| 1.3M | COV047_P3_IgG_24-P1369 | 1539 | EVQLVESGGGLVQPGGSQRLSCAASGFTVSSNYMSWIRQAPGKGLEWVSVIYSGGSAYYVDSVKGRFTISRDNSKNTLYLQMNSLRPEDTAVYYCARIANYMDVWGKGTTVTVSS | 1540 | ARIANYMDV | COV047_P3_Kappa_24-P1389 | 1541 | EIVMTQSPATLSVSPGERATLSCRASQSVSSHLAWYQQKPGQAPRLLIYGASATGIPTRFSGSGSGTEFTLTISSLQSEDFAVYYCQQYNNWPPLTFGGGTKVEIK | 1542 | QQYNNWPPLT | KAPPA |
| 1.3M | COV047_P3_IgG_25-P1369 | 1543 | EVQLVESGGGLVQPGGSLRLSCVASGFTFSSYWMHWVRQVPGKGPVWVSHINSEGSSTNYADSVRGRFTISRDNAKDTLYLQMNNLRAEDTAVYYCARPTAVAAAGNYFYYYGMDVWGQGTTVTVSS | 1544 | ARPTAVAAAGNYFYYYGMDV | COV047_P3_Lambda_25-P1409 | 1545 | QSVLTQPASVSGSPGQSITISCTGTSSDVGYYNFVSWYQQHPGKAPKLMIYEVSNRPSGVSNRFSGSKSGNTASLIISGLQAEDEADYYCSSYRSSSTLVFGGGTKLTVL | 1546 | SSYRSSSTLV | LAMBDA |
| 1.3M | COV047_P3_IgG_35-P1369 | 1547 | QVQLQESGPGLVKPSETLSLTCTVSGGSISSYYWSWIRQPPGKGLEWIGYIYTSGSTNYNPSLKSRVTISVDTSKNQFSLKLSSVTAADTAVYYCARHSWLRGMADYWGQGTLVTVSS | 1548 | ARHSWLRGMADY | COV047_P3_Lambda_35-P1409 | 1549 | NFMLTQPHSVSESPGKTVTISCTGSSGSIASNYVQWYQQRPGSAPTTVIYEDNQRGVPDRFSGSIDSSSNSASLTISGLKTEDEADYYCQSYDSSIWVFGGGTKLTVL | 1550 | QSYDSSIWV | LAMBDA |
| 1.3M | COV047_P3_IgG_38-P1369 | 1551 | QVQLQESGPGLVKPSGTLSLTCAVSGGSISSNWWSWVRQPPGKGLEWIGEIYHSGTTNYNPSLKSRVTISVDKSKNQFSLKLSSVTAADTAVYYCARTWIQPHNWFDPWGQGTLVTVSS | 1552 | ARTWIQPHNWFDP | COV047_P3_Kappa_38-P1389 | 1553 | DIQMTQSPSSLSASVGDRVTITCRASQGISNYLAWFQQKPGKAPKSLIYAASSLQSGVPSKFSGSGSGTDFTLTISSLQPEDFATYYCQQYNSYPLFTFGPGTKVDIK | 1554 | QQYNSYPLFT | KAPPA |
| 1.3M | COV047_P3_IgG_40-P1369 | 1555 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREAARRYDFWSGLNWFDPWGQGTLVTVSS | 1556 | AREAARRYDFWSGLNWFDP | COV047_P3_Kappa_40-P1389 | 1557 | DIVMTQSPDSLAVSXGERATINCKSSQSVLYSSNNKNYLAWYQQKPGQPPKLLIYWASTRESGVPDRFSGSGSGTDFTLTISSLQAEDVAVYYCQQYYSTTMLMLTFGGGTKVEIK | 1558 | QQYYSTMLT | KAPPA |
| 1.3M | COV047_P3_IgG_43-P1369 | 1559 | EVQLVESGGGLIQPGGSLRLSCAASGFTVSNNYMSWVRQAPGKGLEWVSVIYSGGSTYYADSVKGRFTISRDKSKNTLYLQMNRLRAEDTAVYYCAREGEVEGYNDFWSGYSRDRYYFDYWGQGTLVTVSS | 1560 | AREGEVEGYNDFWSGYSRDRYYFDY | COV047_P3_Lambda_43-P1409 | 1561 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL | 1562 | SSYTSSSTRV | LAMBDA |
| 1.3M | COV047_P3_IgG_47-P1369 | 1563 | EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCARDYGDFYFDYWGQGTLVTVSS | 1564 | ARDYGDFYFDY | COV047_P3_Kappa_47-P1389 | 1565 | EIVMTQSPATLSVSPGERATLSCRASQSVSSNLAWYQQKPGQAPRLLIYGASTRATGIPARFSGSGSGTEFTLTISSLQSEDFAVYYCQQYNNWPRTFGQGTKVEIK | 1566 | QQYNNWPRT | KAPPA |
| 1.3M | COV047_ | 1567 | QVQLQESGPGLVKPSETLSLTCTVSGDSMSSY | 1568 | ARLKQQ | COV047_ | 1569 | QSVLTQPPSVSGAPGQRVTISCTGSSSN | 1570 | QSY | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | P3_IgG_49-P1369 | | FWTWIRQPPGKGLECIGYFYPSGSTNYNPSLKSRVTISIDTSKNQFSLKLSSVTAADTAVYYCARLKQQLVGFGWFDPWGQGTLVTVSS | | LVGFGWFDP | P3_Lambda_49-P1409 | | IGADYDVHWYQQFPGTAPKVLIYANTNRPSGVPERFSGSKSGTSASLAITGLQAEDEADYYCQSYDHSLNWVFGGGTKLTVL | | DHSLNWV | |
| 1.3M | COV047_P3_IgG_53-P1369 | 1571 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVPASYGDDDYYYYGMDVWGQGTTVTVSS | 1572 | ARVPASYGDDDYYYYGMDV | COV047_P3_Lambda_53-P1409 | 1573 | SYVLTQPPSVSVSPGQTARITCSGDALPKQYAYWYQQKPGQAPVLVIYKDSERPGIPERFSGSSSGTTVTLTISGVQAEDEADYYCQSADSSGTLWVFGGGTKLTVL | 1574 | QSADSSGTLWV | LAMBDA |
| 1.3M | COV047_P3_IgG_54-P1369 | 1575 | EVQLVESGGGLVKPGGSLRLSCAASGFTFSSAWMSWVRQAPGKGLEWVGRIKTKTDGGTKDYAAPVKGRFTISRDDSKNTLYLQMNSLK1EDTAVYYCTTTNDYGDYSPAYWGQGTLVTVS | 1576 | TTTNDYGDYSPAY | COV047_P3_Kappa_54-P1389 | 1577 | DIQMTQSPSSLSASVGDRVTITCRASQSSYLNWYQQKPGKAPKLLIYAASSLQSGVPSRFSGSGSGTAFTLTISSLQPEDFATYYCQQSYSTPLTFGGGTKVEIK | 1578 | QQSYSTPLT | KAPPA |
| 1.3M | COV047_P3_IgG_5-P1369 | 1579 | QVQLQESGPGLVKPSETLSLTCTVSGGSISSYYWSWIRQPPGKGLEWIGYIYYSRSTNYNPSLKSRVTISVDTSKNQFSLKLSSVTAADTAVYYCARHDTIFGVGQYYFDYWGQGTLVTVSS | 1580 | ARHDTIFGVGQYYFDY | COV047_P3_Lambda_5-P1409 | 1581 | QSVLTQPASVSGSPGQSVTISCTGTSSDVGSYNLVSWYQQHPGKAPKVMIYEDSKRPSGVSNRFSGSKSGNTASLTISGLQAEDEADYYCCSYAGSSTWVFGGGTKLTVL | 1582 | CSYAGSSTWV | LAMBDA |
| 1.3M | COV047_P3_IgG_61-P1369 | 1583 | QVQLVQSGAEVKKPGASVKVSCKASGYTFTSHYMHWVRQAPGQGLEWMGIINPSGGGTSYAQKFQGRVTMTRDTSMSTVYMELSSLRSEDTAVYYCASSSSTPDYYGMDVWGQGTTVTVSS | 1584 | ASSSSTPDYYGMDV | COV047_P3_Kappa_61-P1389 | 1585 | DIQLTQSPSFLSASVGDRVTITCRASQGISSYLAWYQQKPGKAPKLLIYGASTLQSGVPSRFSGSGSGTEFTLTISSLQPEDFATYYCQQLNSYPLCSFGQGTKLEIK | 1586 | QQLNSYPLCS | KAPPA |
| 1.3M | COV047_P3_IgG_64-P1369 | 1587 | QVQLVESGGGVVQPGRSLRLSCAASGFTFSNYGMHWVRQAPGKGLEWVAVISYDGNNKYYADSVKGRFTISRDNSKNTLYLQMNSLRAEDTAVYYCAKDPFPLAVAGTGYFDYWGQGTLVTVSS | 1588 | AKDPFPLAVAGTGYFDY | COV047_P3_Lambda_64-P1409 | 1589 | SYVLTQPPSVSVAPGQTARISCGGNNIGSKNVHWYQQKPGQAPVLVVYDDSDRPSGIPERFSGSNSGNTATLTISRVEAGDEADYYCQVWDSSSDPWVFGGGTKLTVL | 1590 | QVWDSSSDPWV | LAMBDA |
| 1.3M | COV047_P3_IgG_65-P1369 | 1591 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDYGDYYFDYWGQGTLVTVSS | 1592 | ARDYGDYYFDY | COV047_P3_Kappa_65-P1389 | 1593 | EIVMTQSPATLSVSPGERATLSCRASQSVSSNLAWYQQKPGQAPRLLIYGASTRATGIPARFSGSGSGTEFTLTISSLQSEDFAVYYCQQYNNWPRTFGQGTKVEIK | 1594 | QQYNNWPRT | KAPPA |
| 1.3M | COV047_P3_IgG_70-P1369 | 1595 | QVQLVESGGGVVQPGRSLRLSCAASGFTFNNYGMHWVRQAPGKGLEWVAVISYDGNNKYYADSVKDRFTISRDNSKNTLYLQMNNLRAEDTAMYYCARAGWELLRIRYYFDFWGQGTLVTVSS | 1596 | ARAGWELLRIRYYFDF | COV047_P3_Kappa_70-P1389 | 1597 | DIQMTQSPSSLSASVGDRVTITCQASQDISNYLNWYQQKPGKAPKFLIYGASNLETGVPPRFSGSGSGTDFTFIISSLQPEDIATYYCQQYDNLPPTFGGGTKVEIK | 1598 | QQYDNLPPT | KAPPA |
| 1.3M | COV047_P3_IgG_77- | 1599 | QVQLVQSGAEVKKPGASVKVSCKASGYTFTSYNITWVRQAPGQGLEWVGWISAYNGNTNYAQKFQGRVTMTTDTSTSTAYMELRSLRSDDTA | 1600 | ARVPRGYYDRSGYYYLPH | COV047_P3_Kappa_ | 1601 | DIQMTQSPSSLSASVGDRVTITCQASQDISNYLNWYQQKPGKPPKLLIYDASNLETGVPSRFSGSGSGTDFIFSISSLQPEDI | 1602 | QQYDSLPG | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | P1369 | | VYYCARVPRGYYDRSGYYYLPHYLDYWGQGTLTVSS | | YLDY | 77-P1389 | | ATYYCQQYDSLPGCSFGQGTKLEIK | | CS | |
| 1.3M | COV047_P3_IgG_78-P1369 | 163 | QVQLVQSGAEVKKPGASVKVSCKASGYTFTTYYMHWVRQAPGQGLEWMGIINPSGGSTSYAQKFQGRVTMTRDTSTSTVYMELNSLRSEDTAVYYCARGGSSRYCSSTSCYSFGVDNFDYWGQGTLVTVSS | 1604 | ARGGSSRYCSSTSCYSFGVDNFDY | COV047_P3_Lambda_78-P1409 | 1605 | SYVLTQPPSVSVAPGQTARITCGGNNIGSKSVHWYQQKPGQAPVLVVYDDGDRPSGIPERFSGSNSGNTATLTISRVEAGDEADYYCQVWDSSSDHYYVFGTGTK | 1606 | QVWDSSSDHYYV | LAMBDA |
| 1.3M | COV047_P3_IgG_84-P1369 | 1607 | EVQLVESGGGLVKPGGSLRLSCAASGFTFSTYSMNWVRQAPGKGLEWVSSISSSSSYIYYADSVKGRFTISRDNAKNSLYLQMNSLRAEDTAVYYCARVVANWFDPWGQGTLVTVSS | 1608 | ARVVANWFDP | COV047_P3_Kappa_84-P1389 | 1609 | DIVMTQSPDSLAVSXGERATINCKSSQSVLYSSNNKNYLAWYQQKPGQPPKLLIYWASTRESGVPDRFSGSGSGTDFTLTISSLQAEDVAVYYCQQYYSTPQPSWTFGQGTKVEIK | 1610 | QQYYSTPQPSWT | KAPPA |
| 1.3M | COV047_P3_IgG_8-P1369 | 1611 | EVQLVQSGAEVKKPGESLKISCKGSGYRFTNYWIGWVRQMPGKGLEWMGIIYPGDSDTRYSPSFQGQVTISADKSITTAYLQWSSLKASDTAMYYCARLSDRWYSPFDPWGQGTLVTVSS | 1612 | ARLSDRWYSPFDP | COV047_P3_Lambda_8-P1409 | 1613 | QSVLTQEPSLTVSPGGTVTLTCGSSTGAVTSGHYPYWFQQKSGQAPRTLIYETSIKHSWTPARFSGSLLGGKAALTLSGAQPEDEADYYCLLSYSGARPVFGGGTKLTVL | 1614 | LLSYSGARPV | LAMBDA |
| 1.3M | COV047_P3_IgG_91-P1369 | 1615 | EVQLVQSGAEVKKPGESLKISCKGSGYRFTNYWIGWVRQMPGKGLEWMGIIYPGDSDTRYSPSFQGQVTISADKSITTAYLQWSSLKASDTAMYYCARLSDRWYSPFDPWGQGTLVTVSS | 1616 | ARLSDRWYSPFDP | COV047_P3_Lambda_91-P1409 | 1617 | QSVLTQEPSLTVSPGGTVTLTCGSSTGAVTSGHYPYWFQQKSGQAPRTLIYETSIKHSWTPARFSGSLLGGKAALTLSGAQPEDEADYYCLLSYSGARPVFGGGTKLTVL | 1618 | LLSYSGARPV | LAMBDA |
| 1.3M | COV047_P4_IgG_11-P1369 | 1619 | EVQLVETGGGLIQPGGSLRLSCAASGFTVSSNYMSWVRQAPGKGLEWVSVIYSGGSTFYADSVKGRFTISRDNSKNTLYLQMNSLRAEDTAVYYCARAISESPRYGVYWGQGTLVTVSS | 1620 | ARAISESPRYGVY | COV047_P4_Kappa_11-P1389 | 1621 | DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGQGTRLEIK | 1622 | QQYDNLPLT | LAMBDA |
| 1.3M | COV047_P4_IgG_12-P1369 | 1623 | EVQLVESGGGLVQPGGSLRLSCAASGFSVSTKYMTWVRQAPGKGLEWVSVLYSGGSDYYADSVKGRFTISRDNSKNALYLQMSSLRVEDTGIYYCARDSSEVRDHPGHPGRSVGAFDIWGQGTMVTVSS | 1624 | ARDSSEVRDHPGHPGRSVGAFDI | COV047_P4_Lambda_12-P1409 | 1625 | QSVLTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTV | 1626 | CSYAGASTFV | LAMBDA |
| 1.3M | COV047_P4_IgG_17-P1369 | 1627 | EVQLVESGGGLVKPGGSLRLSCAASGFTFSSYIMNWVRQAPGKGLEWVSSISSSSSYIYYADSVKGRFTISRDNAKNSLYLQMNSLRAEDTAVYYCAREAEWEAFDIWGQGTMVTVSS | 1628 | AREAEWEAFDI | COV047_P4_Lambda_17-P1409 | 1629 | QSVLTQPRSVSGSPGQSVTISCTGTSSDVGGYNYVSWYQQHPGKAPKLMICDVSKRPSGVPDRFSGSKSGNTASLTISGLQAEDEADYYCCSYAGSYTWVFGGGTKLTVL | 1630 | CSYAGSYTWV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV047_P4_IgG_20-P1369 | 1631 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKVDGSYYYYYYGMDVWGQGTTVTVSS | 1632 | AKVDGSYYYYYYGMDV | COV047_P4_Lambda_20-P1409 | 1633 | QSVLTQPASVSGSPGQSITISCTGTSSDVGAYNYVSWYQQHPGKAPKLMIYEVSNRPSGVSNRFSGSKSGNTASLTISGLQAEDEADYYCSSYTSSSTAWVFGGGTKLTVL | 1634 | SSYTSSSTAWV | LAMBDA |
| 1.3M | COV047_P4_IgG_22-P1369 | 1635 | QVQLVESGGGVVQPGRSLRLSCAASGFTFRTYAMHWVRQAPGKGLEWVAVILSDGNNKYYADSVKGRFTISRDNSKNTLYLQMNSLRAEDTAIFYCAREQEANYYDISGYYHWGESLGYWGQGTLVTVPS | 1636 | AREQEANYYDISGYYHWGESLGY | COV047_P4_Kappa_22-P1389 | 1637 | DIQLTQSPSFLSASVGDRVTITCRASQGISSYLAWYQQKPGKAPKLLIYGASTLQSGVPSRFSGSGSGTEFTLTISSLQPEDFASYYCQKVNSHPPGLTFGGGTKVEI | 1639 | QKVNSHPPGLT | KAPPA |
| 1.3M | COV047_P4_IgG_23-P1369 | 1639 | QVQLQQSGPGLVKPSQTLSLTCAISGDSVSSNTAAWNWIRQSPSRGLEWLGRTYYRSKWYNDYAVSVISRIIINPDTSKNQFSLQLKSVTPEDTAVYYCARDILRDTSWPHDAFDIWGQGTMVTVSS | 1640 | ARDILRDTSWPHDAFDI | COV047_P4_Lambda_23-P1409 | 1641 | QSVLTQPASVSGSPGQSITISCTGTSSDVGGYNYLSWYQQHPGKAPKLMIYEVSNRPSGVSNRFSGSKSGNTASLTISGLQAEDEADYYCSSYTSSSTPFYVFGTGTKVTVL | 1642 | SSYTSSSTPFYV | LAMBDA |
| 1.3M | COV047_P4_IgG_27-P1369 | 1643 | QVQLVQSGAEVKKPGASVKVSCKASGYIFTDYSMHWVRQAPGQGLEWIGWVNPNSGGTNYAQKFQGWVTMARDTSITTVYMELSRLKSDDTAVYFCARGPLFHRLVYDFWSGYHDGFDMWGQGTMVTVSS | 1644 | ARGPLFHRLVYDFWSGYHDGFDM | COV047_P4_Lambda_27-P1409 | 1645 | QSVLTQPASVSGSPGQSITISCTGTSSDVGGYKFVSWYQQHPGKAPKLMIYEVSNRPSGVSNRFSGSKSGNTASLTISGLQAEDEADYYCNSYTSSSTWVFGGGTKLT | 1646 | NSYTSSSTWV | LAMBDA |
| 1.3M | COV047_P4_IgG_31-P1369 | 1647 | QVQLVESGGGVVQPGRSLRLSCAASGLTFSFYAIHWVRQAPGKGLEWVAYISYEGSDKYYADSVKGRFTISRANSKSTLYLQMNSLRAEDTAVYYCYALFERGNWNDAEYWGQGTLVTVSS | 1648 | YALFERGNWNDAEY | COV047_P4_Kappa_31-P1389 | 1649 | DVVMTQSPLSLPVTLGQPASISCRSSQSLVHSDGNIYLSWYQQRPGQSPRRLIYKVSNRDSGVPDRFSASGSGTDFTLRISRVEAEDVGVYYCMQGTHWPRTFGQGTKLEIK | 1650 | MQGTHWPRT | KAPPA |
| 1.3M | COV047_P4_IgG_34-P1369 | 1651 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARERGYYGGKTPPFLGGQGTLVTVSS | 1652 | ARERGYYGGKTPPFL | COV047_P4_Lambda_34-P1409 | 1653 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNYWVFGGGTKLTVL | 1654 | QSSDSSNYWV | LAMBDA |
| 1.3M | COV047_P4_IgG_36-P1369 | 1656 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSGGRHYYDSSGYYRLPLDDAFDIWGQGTMVTVSS | 1657 | AKSGGRHYYDSSGYYRLPLDDAFDI | COV047_P4_Lambda_36-P1409 | 1658 | QSVLTQPPSVSGAPGQRVTISCTGSSSSIGAGYDVHWYQQLPGTAPKLLIYGNSNRPSGVPDRFSGSKSGTSASLAITGLQAEDEADYYCQSYDSSLSGSWVFGGGTKL | 1659 | QSYDSSLSGSWV | LAMBDA |
| 1.3M | COV047_P4_IgG_38-P1369 | 1659 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARYQLAPGSGSYYNWGGYPRESEYYFDYWGQGTLVTVSS | 1660 | ARYQLAPGSGSYYNWGGYPRESEYFYDY | COV047_P4_Lambda_38-P1409 | 1661 | QSVLTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTWVFGGGTKLTVL | 1662 | CSYAGSYTWV | LAMBDA |
| 1.3M | COV047_ | 1663 | QVQLQESGPGLVKPSQTLSLTCAVSGDSIRSG | 1664 | ARVKG | COV047_ | 1665 | NFMLTQSHSVSESPGKTVTISCTGSSGN | 1666 | QSY | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | P4_IgG_39-P1369 | | GYYWSWVRQHPGRGLEWIGYIYFSGTTYYNPSLKSRVTISVDTSEKQFSLKLTSVTDADTAVYFCARVKGWLRGYFDYWGQGAPVTVSA | | WLRGYFDY | P4_Lambda_39-P1409 | | IVNNYVQWYQQRPGSAPIIVIYEDTQRPSGVPDRFSGSIDTSSNSASLTISGLKTEDEADYYCQSYDSGSHVVFGGGTKLTV | | DSGSHVV | |
| 1.3M | COV047_P4_IgG_3-P1369 | 167 | EVQLVESGGGLVQPGGSLRLSCAASGFSVSTKYMTWVRQAPGKGLEWVSVLYSGGSDYYADSVKGRFTISRDNSKNALYLQMNSLRVEDTGVYYCARDSSEVRDHPGHPGRSVGAFDIWGQGTMVTVSS | 1668 | ARDSSEVRDHPGHPGRSVGAFDI | COV047_P4_Lambda_3-P1409 | 1669 | QSVLTQPASVSGSPGQSITISCTGTSNDVGSYTLVSWYQQYPGKAPKLLIFEVTKRSSGISNRFSGSKSGNTASLTISGLQGEDEADYYCCSYAGASTFVFGGGTKLTV | 1670 | CSYAGASTFV | LAMBDA |
| 1.3M | COV047_P4_IgG_43-P1369 | 1671 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARVGYGYYFDYWGQGTLVTVSS | 1672 | ARVGYGYYFDY | COV047_P4_Kappa_43-P1389 | 1673 | EIVLTQSPATLSLSPGERATLSCRASQSVSSYLAWYQQKPGQAPRLLIYDASNRATGIPARFSGSGSGTDFTLTISSLEPEDFAVYYCQQRSNWPSFGQGTKLEIK | 1674 | QQRSNWPS | KAPPA |
| 1.3M | COV047_P4_IgG_48-P1369 | 1675 | QVQLVQSGAEVKKPGASVKVSCKASGYTFTSYYIHWVRQAPGQGLEWMGIINPSDGGTSYAQKFQGRVTMTRDTSTSTVYMELSSLRSEDTAVYSCARASTSTTNWNDALSLGCWGQGTLVTVSS | 1676 | ARASTSTTNWNDALSLGC | COV047_P4_Lambda_48-P1409 | 1677 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSGLSGSGVVFGGGT | 1678 | QSYDSGLSGSGVV | LAMBDA |
| 1.3M | COV047_P4_IgG_50-P1369 | 1679 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRKYSSGWSVVNFDYWGQGTLVTVSS | 1680 | ARDRKYSSGWSVVNFDY | COV047_P4_Lambda_50-P1409 | 1681 | QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNGWVFGGGTKLT | 1682 | AAWDDSLNGWV | LAMBDA |
| 1.3M | COV047_P4_IgG_51-P1369 | 1683 | EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCARDSTPGYGDYISGQGTLVTVSS | 1684 | | COV047_P4_Kappa_51-P1389 | 1685 | DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK | 1686 | QQYDNLPIT | KAPPA |
| 1.3M | COV047_P4_IgG_52-P1369 | 1687 | QVQLVESGGGVVQPGRSLRLSCADSGFTFSTYGMHWVRQAPGKGLEWVALISYDGSNKYYADSVKGRFTISGDNSKNTLYLQMNSLRAEDTAVYYCARAEWLRGAFDIWGQGTMVTVSS | 1688 | ARAEWLRGAFDI | COV047_P4_Lambda_52-P1409 | 1689 | NFMLTQPHSVSESPGKTVTISCTGSSGSIASNYVQWYQQRPGSAPTTVIYEDNQRGVPDRFSGSIDSSSNSASLTISGLKTEDEADYYCQSYDSTNHWVFGGGTKLTVL | 1690 | QSYDSTNHWV | LAMBDA |
| 1.3M | COV047_P4_IgG_57-P1369 | 1691 | EVQLVESGGGLIQPGGSLRLSCAASGFSVSSNYMSWVRQAPGKGLEWVSVIYSGGSTYYADSVKGRFTISRDNSKNTLYLQMNSLRAEDTAVYYCAREGEVEGYYDFWSGYSRDRYYFDYWGQGTLVTVSS | 1692 | AREGEVEGYYDFWSGYSRDRYYFDY | COV047_P4_Lambda_57-P1409 | 1693 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSTTRVFGTGTRVTVL | 1694 | SSYTSSTTRV | LAMBDA |
| 1.3M | COV047_P4_IgG_58- | 1695 | EVQLVESGGGLIQPGGSLRLSCAASGFTVSNNYMSWVRQAPGKGLEWVSVIYSGGSTYYADSLKGRFTISRDNSKNTLYLQMNSLRAEDTAVY | 1696 | AREGEVEGYYDFWSGYSR | COV047_P4_Lambda_ | 1697 | QSALTQPASVSGSPGQSITISCTGTSSDVGGYNYVSWYQQHPGKAPKLMIYDVSNRPSGVSNRFSGSKSGNTASLTISGLQ | 1698 | SSYTSISTRV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | P1369 | | YCAREGEVEGYYDFWSGYSRDRYYFDYWGQGTLVTVSS | | DRYYFDY | 58-P1409 | | AEDEADYYCSSYTSISTRVFGTGTKVTVL | | | |
| 1.3M | COV047_P4_IgG_60-P1369 | 1699 | QVQLVQSGAEVKKPGASVKVSCKASGYTFTGYYIHWVRQAPGQGLEWMGWINPNSGGTKYAQKFQGWVTMTRDTSITTVYMELSRLRSDDTAVYYCARGTEYNWNSAHFDPWGQGTLVTVSS | 1700 | ARGTEYNWNSAHFDP | COV047_P4_Lambda_60-P1409 | 1701 | QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTSWVFGGGTKLTVL | 1702 | SSTTSSSTSWV | LAMBDA |
| 1.3M | COV047_P4_IgG_65-P1369 | 1703 | EVQLVESGGGLVQPGGSLRLSCAASGFSVSTKYMTWVRQAPGKGLEWVSVLYSGGSDYYADSVKGRFTISRDNSKNALYLQMSSLRVEDTGIYYCARDSSEVRDHPGHPGRSVGAFDIWGQGTMVTVSS | 1704 | ARDSSEVRDHPGHPGRSVGAFDI | COV047_P4_Lambda_65-P1409 | 7105 | QSALTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL | 1706 | CSYAGASTFV | LAMBDA |
| 1.3M | COV047_P4_IgG_67-P1369 | 1707 | EVQLVESGGGLVKPGGSLRLSCAASGFTFSSYSMNWVRQAPGKGLEWVSSISSSTSYIYYADSVKGRFTISRDNAKNSLYLQMNSLRAEDTAVYYCARERYGDNWGQGTLVTVSS | 1708 | ARERYGDN | COV047_P4_Lambda_67-P1409 | 1709 | QLVLTQSPSASASLGASVKLTCTLSSGHSSYAIAWHQQQPEKGPRYLMSLNSDGSHSKGDGIPDRFSGSSSGAERYLTISSLQSEDEADYYCQTWGPWVFGGGTKLTVL | 1710 | QTWGPWV | LAMBDA |
| 1.3M | COV047_P4_IgG_69-P1369 | 1711 | QVQLVESGGGVVQPGRSLRLSCTASGFTFSSYGMHWVRQAPGKGLEWVAVISYDGSNKYYADSVKGRFTISRDNSKNTLYLQMNSLRAEDTAVYYCAKVGLGYSSGWYGEEIDYWGQGTLVTVSS | 1712 | AKVGLGYSSGWYGEEIDY | COV047_P4_Kappa_69-P1389 | 1713 | DIQMTQSPSSLSASVGDRVTITCRASQSISSFLNWYQQKPGKAPNLLIYAASSLQSGVPSRFSGSGSGTDFTLTISSLQPEDFATYYCQQSYRTPLTFGGGTKVEIK | 1714 | QQSYRTPLT | KAPPA |
| 1.3M | COV047_P4_IgG_70-P1369 | 1715 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGGRYYDSSGYNGTYEFDYWGQGTLVTVSS | 1716 | ARGGRYYDSSGYNGTYEFDY | COV047_P4_Kappa_70-P1389 | 1717 | EIVMTQSPATLSVSPGERATLSCRASQSVSSNLAWYQQKPGQAPRLLIYGASTRATGIPARFSGSGSGTEFTLTISSLQSEDFAVYYCQQYNNWPPVTFGPGTKVDIK | 1718 | QQYNNWPPVT | KAPPA |
| 1.3M | COV047_P4_IgG_72-P1369 | 1719 | QVQLQESGPGLVKPSETLSLTCTVSGGSISNYYWSWIRQPPGKGLEWIGYIYTSGSTNYNPSLKSRVTISVDTSKNQFSLKLSSVTAADTAVYYCARGPPRLLWFGESPPTYWYFNLWGRGTLVTVSS | 1720 | ARGPPRLLWFGESPPTYWYFNL | COV047_P4_Kappa_72-P1389 | 1721 | DIVMTQSPDSLAVSXGERATINCKSSQSVLYSSNNKNYLAWYQQKPRQPPKLLIYWASTRESGVPDRISGSGSGTDFTLTISSLQAEDVAVYYCQQYYSTPLTFGGGTKVEIK | 1722 | QQYYSTPLT | KAPPA |
| 1.3M | COV047_P4_IgG_83-P1369 | 1723 | QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARVAAFLDYWGQGTLVTVSS | 1724 | ARVAAFLDY | COV047_P4_Kappa_83-P1389 | 1725 | DIQMTQSPSSLSASVGDRVTITCRASQGISNSLAWYQQKPGKAPKLLLYAASRLESGVPSRFSGSGSGTDYTLTISSLQPEDFATYYCQQYYSTRTFGQGTKVEIK | 1726 | QQYYSTRT | KAPPA |
| 1.3M | COV047_P4_IgG_86-P1369 | 1727 | QLQLQESGSRLVKPSQTLSLTCAVSGGSISSGGYSWSWIRQPPGKGLQWIGYIYHSGSTYYNPSLKSRVTISVDRSKNQFSLKLSSVTAADTAVYYCARFTNPNYYDSSGYYGFDYWGQGTLVTVSS | 1728 | ARFTNPNYYDSSGYYGFDY | COV047_P4_Lambda_86-P1409 | 1729 | QSVLTQPPSASGSPGQSVTISCTGTSSDVGGYNYVSWYQQHPGKAPKLMIYEVSKRPSGVPDRLSGSKSGNTASLTVSGLQAEDEADYYCTSYAGSNNWVFGGGTKLTVL | 1730 | TSYAGSNNWV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV047_P4_IgG_89-P1369 | 1731 | QVQLVQSGAEVKKPGSSVKVSCKASGGTFSSDAISWVRQAPGQGLEWMGGIMPIFGTANYAQKFQGRVTITADESTSTAYMELSSLRSEDTAVYYCARDLRYCSGGRCLWWFDPWGQGTLVTVSS | 1732 | ARDLRYCSGGRCLWWFDP | COV047_P4_Kappa_89-P1389 | 1733 | DIQMTQSPSSLSASVGDRVTITCRASQSINNYLNWYQQKPGKAPKLLIYAASSLQSGVPSRFSGSGSGTDFTLTISSLQPEDFATYYCQQSYSTPRTFGPGTKVDIK | 1734 | QQSYSTPRT | KAPPA |
| 1.3M | COV047_P4_IgG_91-P1369 | 1735 | QVQLVESGGGVVQPGRSLRLSCAASGFTFSSYGMHWVRQAPGKGLEWVAVTSYDGTNKYYADSVKGRFTISRDNSKNTLYLQMNSLRAEDTAVYFCAKNVGTGYNVMYYFDYWGQGTLVTVSS | 1736 | AKNVGTGYNVMYYFDY | COV047_P4_Kappa_91-P1389 | 1737 | DIQMTQSPSSLSASVGDRVTITCQASQDISNYLNWYQQKPGKAPKLLIYDTSNLERGVPSRFSGSGSGSDFTFTISSLQPEDIATYYCQQYDNLPITFGQGTRLEIK | 1738 | QQYDNLPIT | KAPPA |
| 1.3M | COV047_P5_IgG_10-P1369 | 1739 | QVQLVQSGAEVKKPGASVKVSCKASGYTFTGYYLHWVRQAPGQGLEWMGWINPNSGGTNYAQKFQGWVTMTRDTSISTAYMELSRLRSDDTAVYYCARTPRVYDPTLPNQWLVGEYYCDYWGQGTLVTVSS | 1740 | ARTPRVYDPTLPNQWLVGEYYCDY | COV047_P5_Lambda_10-P1409 | 1741 | QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTWVFGGGTKLTVL | 1742 | CSYAGSYTWV | LAMBDA |
| 1.3M | COV047_P5_IgG_15-P1369 | 1743 | QVQLVQSGAEVKKPGSSVKVSCKASGGTFSSNYAISWVRQAPGQGLEWMGGIIPIFGTANYAQKLQGRVTITTDESTSTAYMELSSLRSEDTAVYYCARYTYYYDRSGYYRPDYFDYWGQGTLVTVSS | 1744 | ARYTYYYDRSGYYRPDYFDY | COV047_P5_Kappa_15-P1389 | 1745 | AIQLTQSPSSLSASVGDRVTITCRASQGISTVLAWYQQKPGKTPKLLIYDASSLESGAPSRFSGSGSGTDFTLTISSLQPEDFATYYCQQFNSYQLTFGGGTKVEIK | 1746 | QQFNSYQLT | KAPPA |
| 1.3M | COV047_P5_IgG_16-P1369 | 1747 | EVQLVESGGGLVQPGGSLRLSCAASGFTFSSYWMHWVRQAPGKGLVWVSHINGDGSSTSYADSVKGRFTISRDNAKNTLYLQMNSLRAEDTAVYYCASAFWQRGNFDYWGQGTLVTVSS | 1748 | ASAFWQRGNFDY | COV047_P5_Lambda_16-P1409 | 1749 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSILWVFGGGTKLTVL | 1750 | QSYDSSILWV | LAMBDA |
| 1.3M | COV047_P5_IgG_21-P1369 | 1751 | QVQLVQSGAEVKKPGASVKVSCKASGYTFTSYDISWVRQAPGQGLEWMGWINAYNGNTNYAQKLQGRVTMTTDTSTSTAYMELRSLRSDDTAVYYCARPSSSLTSYFDYWGQGTLVTVSS | 1752 | ARPSSSLTSYFDY | COV047_P5_Lambda_21-P1409 | 1753 | SYVLTQPPSVSVAPGQTARITCGGNNIGSKNVHWYQQKPGQAPVLVVYDDSDRPSGIPERFSGSNSGNTATLTISRVEAGDEADYYCQVWDSSSDRHWVFGGGTKLTVL | 1754 | QVWDSSSDRHWV | LAMBDA |
| 1.3M | COV047_P5_IgG_24-P1369 | 1755 | EVQLVESGGGLVKPGGSLRLSCAASGFTFSSYNMNWVRQAPGKGLEWVSCISSSSSYIYYADSVKGRFTISRDNAKNSLYLQMNSLRAEDTAVYYCARERGYDGGKTPPFLGGQGTLVTVSS | 1756 | ARERGYDGGKTP | COV047_P5_Lambda_24-P1409 | 1757 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNYWVFGGGTKLTV | 1758 | QSYDSSNYWV | LAMBDA |
| 1.3M | COV047_P5_IgG_26-P1369 | 1759 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCAREGDVEGYYDFWSGYSRDRYYFDYWGQGTLVTVSS | 1760 | AREGDVEGYYDFWSGYSRDRYYFDY | COV047_P5_Lambda_26-P1409 | 1761 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL | 1762 | SSYTSSSTRV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV047_P5_IgG_27-P1369 | 1763 | EVQLVESGGGLIQPGGSLRLSCAASGFIVSSNYMSWVRQAPGKGLEWVSVIYSGGSTFYADSVKGRFTISRDNSKNTLYLQMNSLRAEDTAVYYCARDFGEFYFDYWGQGTLVTVSS | 1764 | ARDFGEFYFDY | COV047_P5_Kappa_27-P1389 | 1765 | EIVMTQSPATLSVSPGERATLSCRASQSVSSNLAWYQQKPGQAPRLLIYGASTRATAIPARFSGSGSGTEFTLTISSLQSEDFAVYYCQQYNNWPRTFGQGTKVEIK | 1766 | QQYNNWPRT | KAPPA |
| 1.3M | COV047_P5_IgG_29-P1369 | 1767 | QVQLVQSGAEVKKPGASVKVSCMASGYTLTAYYIHWVRQAPGQGLESLGWINPRTGGTTILQKFQGWVTMTRDTSINTVYLELPRVTLADTAVYYCVRGGTWNYVGGEVWGQGTAVTVSS | 1768 | VRGGTWNYVGGEV | COV047_P5_Lambda_29-P1409 | 1769 | QSALTQPASVSGSPGQSITVSCAGSSTDVGGYNFVSWYQHHPGRVPKLIIYEVNNRPSGVSVRFSGSKSGNTASLTISGLQAEDEADYYCTSFTSSSDSWIFGGGTKLTVL | 1770 | TSFTSSSDSWI | LAMBDA |
| 1.3M | COV047_P5_IgG_30-P1369 | 1771 | QVQLVESGGGVVQPGRSLRLSCAASGFTFSGYDIHWVRQAPGKGLEWVAVISYDGSSKFYADSVKGRFTISRDNSKNTLYLQMNSLRAEDTAVYYCAKDLGSSLYYDAFDIWGQGTMVTVSS | 1772 | AKDLGSSLYYDAFDI | COV047_P5_Kappa_30-P1389 | 1773 | DIQMTQSPSSLSASVGDRLTITCRASQSITSYLNWYQQKPGKAPKLLIYAASSLQSGVPSRFSGSGSGTDFTLTISSLQPEDFATYYCQQSYSTPPWTFGQGTKVEIK | 1774 | QQSYSTPPWT | KAPPA |
| 1.3M | COV047_P5_IgG_41-P1369 | 1775 | EVQLVESGGGLIQPGGSLRLSCAASGFTVRNNYMSWVRQAPGKGLEWVSVIYSGGSTYYADSVKGRFTISRDNSKNTLYLQMNSLRAEDTAVYYCAREGEVEGYYDFWSGYSRDRYYFDYWGQGTLVTVSS | 1776 | AREGEVEGYYDFWSGYSRDRYYFDY | COV047_P5_Lambda_41-P1409 | 1777 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL | 1778 | SSYTSSSTRV | LAMBDA |
| 1.3M | COV047_P5_IgG_49-P1369 | 1779 | EVQLVESGGGLIQPGGSLRLSCAASGFSVSSNYMSWVRQAPGKGLEWVSVIYSGGSTYYADSVKGRFTISRDNSKNTLYLQMNSLRAEDTAVYYCAREGEVEGYYDFWSGYSRDRYYFDYWGQGTLVTVSS | 1780 | AREGEVEGYYDFWSGYSRDRYYFDY | COV047_P5_Lambda_49-P1409 | 1781 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSTTRVFGTGTRVTVL | 1782 | SSYTSSTTRV | LAMBDA |
| 1.3M | COV047_P5_IgG_57-P1369 | 1783 | EVQLVESGGGLVQPGGSLRLSCAASGFSVSTKYMTWVRQAPGKGLEWVSVLYSGGSDYYADSVKGRFTISRDNSKNALYLQMNSLRVEDTGVYYCARDSSEVRDHPGHPGRSVGAFDIWGQGTMVTVSS | 1784 | ARDSSEVRDHPGHPGRSVGAFDI | COV047_P5_Lambda_57-P1409 | 1785 | QSVLTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL | 1786 | CSYAGASTFV | LAMBDA |
| 1.3M | COV047_P5_IgG_58-P1369 | 1787 | EVQLVESGGGLIQPGGSLRLSCAASGFTVSSNYMSWVRQAPGKGLEWVSVIYSGYSTYYVDSVKGRFTISRDNSKNTLYLQMNSLRAEDTAVYYCARVGGAHSGYDGSFDYWGQGTLVTVSS | 1788 | ARVGGAHSGYDGSFDY | COV047_P5_Lambda_58-P1409 | 1789 | QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVL | 1790 | CSYAGSSTWV | LAMBDA |
| 1.3M | COV047_P5_IgG_59-P1369 | 1791 | QVQLVESGGGVVQPGRSLRLSCAASGFMFSSYGMHWVRQAPGKGLEWVAVIWYDGSNKYYADSVKGRFTISRDNSKNTLYLQMNSLRAEDTAVYYCARDGLNWNVPHYGMDVWGQGTTVTVSS | 1792 | ARDGLNWNVPHYGMDV | COV047_P5_Kappa_59-P1389 | 1793 | DIQMTQSPSSVSASVGDRVTITCRASQGISSWLAWYQQKPGKAPKLLIYAASSLQSGVPSRFSGSGSGTDFTLTISSLQPEDFATYYCQQANSFPPLTFGGGTKVEIK | 1794 | QQANSFPPLT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV047_P5_IgG_68-P1369 | 1795 | QVQLVESGGGVVQPGRSLRLSCAASGFTFSTYGMHWVRQAPGKGLEWVAVISYDGSNKYFADSVKGRFTISRDNSKNTLYLQMNSLRPEDTAVYYCAKVGMEYSSGWYGEEIDFWGQGTLVTVSS | 1796 | AKVGMEYSSGWYGEEIDF | COV047_P5_Kappa_68-P1389 | 1797 | DIQMTQSPSSLSASVGDRVTITCRASQSISSYLNWYQQKPGKVPKLLIYAASSLQSGVPSRFSGSGSGTDFTLTISSLQPEDFATYYCQQSYRTPLTFGGGTKVEIK | 1798 | QQSYRTPLT | KAPPA |
| 1.3M | COV047_P5_IgG_71-P1369 | 1799 | EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCARDLRDQDGYSYGAFDYWGQGTLVTVSS | 1800 | ARDLRDQDGYSYGAFDY | COV047_P5_Lambda_71-P1409 | 1801 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSSWVFGGGTKLT | 1802 | SSYTSSSSWV | LAMBDA |
| 1.3M | COV047_P5_IgG_72-P1369 | 1803 | EVQLVESGGGLVKPGGSLRLSCAVSGFTFSNVWMRWVRQAPGKGXEWVGRIKSKTDGGTTXYAAPVKGRFTXSRDDSKNTLYLQMNSLKDTAVYYCTSQVWLRGPGDYWGQGTLVTVSS | 1804 | TSQVWLRGPGDY | COV047_P5_Lambda_72-P1409 | 1805 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSLNWVFGGGTKLTVL | 1806 | QSYDSSLNWV | LAMBDA |
| 1.3M | COV047_P5_IgG_77-P1369 | 1807 | QVQLVESGGGVVQPGRSLRLSCAASGFTFSSYGMHWVRQAPGKGLEWVAVISYDGSNKHYADSVKGRFTISRDNSKNTLYLQMNSLRAEDTAVYYCAKDPWELRQGNYFDYWGQGTLVTVSS | 1808 | AKDPWELRQGNYFDY | COV047_P5_Lambda_77-P1409 | 1809 | SYVLTQPPSVSVAPGQTARITCGGNNIGSKNVHWYQQKPGQAPVLVVYDDSDRPSGIPERFSGSNSGTTATLTISRVEAGDEADYYCQVWDSSSDPWVFGGGTKLTVL | 1810 | QVWDSSSDPWV | LAMBDA |
| 1.3M | COV047_P5_IgG_78-P1369 | 1811 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDSAYSGYDFFEAPRDYWGQGTLVTVSS | 1812 | ARDSAYSGYDFFEAPRDY | COV047_P5_Kappa_78-P1389 | 1813 | DIQMTQSPSSLSASVGDRVTITCRASQSISSFLNWYQQKPGKAPKLLIYAASSLHSGVPSRFSGSGSGTDFTLTISSLQPEDFATYYCQQSYRTPPLFGGGTKVEI | 1814 | QQSYRTPPL | KAPPA |
| 1.3M | COV047_P5_IgG_84-P1369 | 1815 | EVQLVESGGGLVKPGGSLRLSCAASGLTFTAYRMNWVRQAPGKGLEWLSSISNTNGDIDSVKGRFTISRDNAKNSLYLQMNSLRADDTAVYYCARDVASNYAYFDLWGQGTLVTVSS | 1816 | ARDVASNYAYFDL | COV047_P5_Kappa_84-P1389 | 1817 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPLTFGGGTKVEIK | 1818 | QQSYSTPPLT | KAPPA |
| 1.3M | COV047_P5_IgG_87-P1369 | 1819 | QVQLVESGGGVVQPGRSLRLSCAASGFTFSRYGMHWVRQAPGKGLEWVAVMSYDGSSKYYADSVKGRFTISRDNSKNTLCLQMNSLRAEDTAVYYCAKQAGPYCSGGSCYSAPFDYWGQGTLVTVSS | 1820 | AKQAGPYCSGGSCYSAPFDY | COV047_P5_Kappa_87-P1389 | 1821 | DIQMTQSPSSLSASVGDRVTITCQASQGISNYLNWYQQKPGKAPKLLIYDASNLETGVPSRFSGSGSGTDFTFTISSLQPEDIATYYCQQYDNLPITFGQGTRLEIK | 1822 | QQYDNLPIT | KAPPA |
| 1.3M | COV047_P5_IgG_8-P1369 | 1823 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDRVIYGMDVWGQGTTVTVSS | 1824 | ARDRVIYGMDV | COV047_P5_Kappa_8-P1389 | 1825 | DIQMTQSPSSLSASVGDRVTITCQASQDISNYLNWYQQKPGKAPKLLIYDASNLETGVPSRFSGSGSGTDFTFTISSLQPEDIATYYCQQYDNLPQTFGGGTKVEIK | 1826 | QQYDNLPQT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV047_P5_IgG_90-P1369 | 1827 | EVQLVESGGGLVQPGGSLRLSCAASGFSVSTKYMTWVRQAPGKGLEWVSALYSGGSDYYADSVKGRFTISRDNSKNTLYLQMSSLRVEDTGVYYCARDSSEVRDHPGHPGRSVGAFDIWGQGTMVTVSS | 1828 | ARDSSEVRDHPGHPGRSVGAFDI | COV047_P5_Lambda_90-P1409 | 1829 | QSALTQPASVSGSPGQSITISCTGTSNDVGSYTLVSWYQQYPGKAPKLLIFEDTKRSSGISNRFSGSKSGNTASLTISGLQGEDEADYYCCSYAGTSTFVFGGGTKLTV | 1830 | CSYAGTSTFV | LAMBDA |
| 1.3M | COV047_P5_IgG_91-P1369 | 1831 | EVQLVESGGGLVQPGGSLRLSCAASGFSVSTKYMTWVRQAPGKGLEWVSALYSGGSDYYADSVKGRFTISRDNSKNTLYLQMSSLRVEDTGVYYCARDSSEVRDHPGHPGRSVGAFDIWGQGTMV | 1832 | ARDSSEVRDHPGHPGRSVGAFDI | COV047_P5_Kappa_91-P1389 | 1833 | DIVMTQSPDSLAVSXGERATINCKSSQSVLYSSNNKNYLAWYQQKPGQPPKLLIYWASTRESGVPDRFSGSGSGTDFTLTISSLQAEDVAVYYCQQTPLYYSTPLTFGGG | 1834 | QQYYSTPLT | KAPPA |
| 1.3M | COV047_P5_IgG_94-P1369 | 1835 | EVQLVESGGGLVQPGGSQRLSCAASGFTVSSNYMSWIRQAPGKGLEWVSVIYSGGSAYYVDSVKGRFTISRDNSKNTLYLQMNSLRAEDTAVYYCARIANYMDWVGKGTTVTVSS | 1836 | ARIANYMDV | COV047_P5_Kappa_94-P1389 | 1837 | EIVMTQSPATLSVSPGERATLSCRASQSVSSHLAWYQQKPGQAPRLLIYGASTRATGIPTRFSGSGSGTEFTLTISSLQSEDFAVYYCQQYNNWPPLTFGGGTKVEIK | 1838 | QQYNNWPPLT | KAPPA |
| 1.3M | COV047_P5_IgG_95-P1369 | 1839 | QVQLVQSGAEVKKPGASVKVSCKASGYNFTSYGISWVRQAPGQGLEWMGWISGYNGNTNYGQKFQGGVTMTTDTSTSTAYMELRSLRSDDTAVYYCARDRGGHNFWSGYGYYYYYGMDVVVGQGTTVTVSS | 1840 | ARDRGGHNFWSGYGYYYYGMDV | COV047_P5_Kappa_95-P1389 | 1841 | DIQMTQSPSSLXASVGDRVTITCRASQGISNYLAWYQQKPGKVPKLLIYAASTLQSGVPSRFSGSESGTDFTLTISSLQPEDVATYYCQKYNSAPRTFGQGTKVEIK | 1842 | QKYNSAPRT | KAPPA |
| 6.2M | COV57_mo6_HC_P1B11-p1369 | 1843 | EVQLVESGGGLVQPGRSLRLSCTGSEFTFGDFSMSWFRQAPGKGLEWVGFIRRKADGGTIEYAASVRGRFTISRDDSKSIAYLVMNSLKSEDTAVYYCTRAWIPTPHDYWGQGVLVTVSS | 1844 | TRAWIPTPHDY | COV57_mo6_L_P1B11-p1409 | 1845 | QSVLTQPPSASGTPGQRVTISCSGSSSNIGSNPVNWYQQLPGTAPKLLIYSNNRRPSGVPDRFSGSKSGASASLAISGLQSEDEAAYYCAAWDDSRKGPVFGGGTKLTV | 1846 | AAWDDSRKGPV | LAMBDA |
| 6.2M | COV57_mo6_HC_P1D12-p1369 | 1847 | QVQLVESGGGVVQPGRSLRLSXAASGFTFSTYGMHWVRQAPGKGLEWVAVISYDGSDKYYADSVKGRFAISRDNSKNTLFLQMNSLRAEDTAVYYCAKPLGRYCSSTNCLRGYLDYWGQGTLVTVSS | 1848 | AKPLGRYCSSTNCLRGYLDY | COV57_mo6_L_P1D12-p1409 | 1849 | QSVLTQPASVSGSPGQSITISCTGTSSDVGSYNLVSWYQQHSGKAPKLMIYEISKRPSGISNRFSGSKSGNTASLTISGLQAEDEADYYCCSYADNHTPVVFGGGTKLTVL | 1850 | CSYADNHTPVV | LAMBDA |
| 6.2M | COV57_mo6_HC_P2E8-p1369 | 1851 | QVQLVESGGGVVQPGGSLRLSCAASLFSFSDYGMHWVRQAPGKGLEWVAFIWYDGTKKDYTHSVKGRFTVSRDNSKNTLYLQMNSLRAEDTAMYYCAKARGFQHYFDQWGQGTLVTVSS | 1852 | AKARGFQHYFDQ | COV57_mo6_L_P2E8-p1409 | 1853 | QSVLTQPASVSGSPGQSITISCTGTSSDVGSYNLVSWYQQHPGKAPKLLIYEVGKRPSGVSNRFSGSKSGNTASLTISGLQAEDEADYYCCSYAGSGTLGVVFGGGTKLTVL | 1854 | CSYAGSGTLGVV | LAMBDA |
| 6.2M | COV57_mo6_HC_P2C6-p1369 | 1855 | QVQLQESGPGLEKPSETLSLTCTVSGGSISSYYWSWIRQPPGKGLEWIGYVHYSGSTKYNPSLKSRVTISVDTSKTQFSLNLSSVTAADTAVYYCARDTGPYYYGMDVWGQGTTVTVSS | 1856 | ARDTGPYYYGMDV | COV57_mo6_L_P2C6-p1409 | 1857 | QSVLTQPRSVSGSPGQSVTISCTGTSSDVGGYDYVSWYQQHPGKAPKLIIYDVTKRPSGVPDRFSGSKSGNTASLTISGLQTEDEADYSCGSYAGSFRIFGGGTKLTV | 1858 | GSYAGSFRI | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 6.2M | COV57_mo6_HC_P2A5-p1369 | 1859 | QVQLQESGPGLVKPSETLSLTCNVSGVSISTDYWSWIRQPPGKGLEWIGYIYYSGNTKDYNPSLKSRVTISVDTSKNQFSLMLSSVTAADTAVYYCARHYDILTSLSWFDPWGQGTLVTVSS | 1860 | ARHYDILTSLSWFDP | COV57_mo6_L_P2A5-p1409 | 1861 | QSVLTQPPSVSAAPGQKVTISCSITNSNLGNIYVSWYQQLPGTAPKLLIYGNNKRPSGIPDRFSGSKSGTSATLGITGLQTGDEAHYYCGTWDSSLSANWVFGGGTKLTVL | 1862 | GTWDSSLSANWV | LAMBDA |
| 6.2M | COV57_mo6_HC_P1D7-p1369 | 1863 | QVQLVESGGGVVQPGRSLRLSCAASGFTFRSYGMHWVRQAPGKGLEWVAVISYDGSNKYYADSVKGRFTISRDNSKNTLYLQMNSLRAEDTAVYYCAKSEGQYCSGGSCSSADYYYYGMDVVVGQGTTVTVSS | 1864 | AKSEGQYCSGGSCSSADYYYYGMDV | COV57_mo6_L_P1D7-p1409 | 1865 | QSVLTQEPSLTVSPGGTVTLTCGSSTGVVTSGHYPYWFQQKPGQAPRTLIYDTSNKHSWTPARFSGSLLGGKAALTLSGAQPEDEAEYYCLLSYSGARPVFGGGTKLTVL | 1866 | LLSYSGARPV | LAMBDA |
| 6.2M | COV57_mo6_HC_P2D10-p1369 | 1867 | QVQLVESGGGVVQPGRSLRLSCAASGFTFSSYGLHWVRQAPGKGLEWVALISSDGTNKYYADSVKGRFTISRDNSKKTEYLQMNSLRAEDTAVYYCAKDLTDTSGWDDDYYYYYGMDAWGQGTTVTVSS | 1868 | AKDLTDTSGWDDDYYYYYGMDA | COV57_mo6_L_P2D10-p1409 | 1869 | SYVLTQPPSVSVSPGQTASITCSGDKLGEKSASWYQQKPGQSPVLVIYRDTERPSGIPERFSGSNSGTTATLTISGALAMDEAEYYCQAWDKSTVVFGGGTTLTV | 1870 | QAWDKSTVV | LAMBDA |
| 6.2M | COV57_mo6_HC_P1C4-p1369 | 1871 | QVQLQQSGPGLLKPSQTLSLTCAISGDSVSSSGAAWNWIRQSPSRGLEWLGRTYYKSKWYNDYAVSVKSRITINPDTSKNQFSLQLNSVTPEDTAVYYCARMWVVAGTTDDYYYHYGMDVVVGQGTTVTVSS | 1872 | ARMWVVAGTTDDYYYHYGMDV | COV57_mo6_L_P1C4-p1409 | 1873 | SYVLTQPPSVSVSPGQTARITCSGNALPKQYVYWYQQKPGQAPVLVIYKDSERPSGIPERFSGSSSGTTVTLTISGVQAEDEAEYYCQSADSTGTYVIFGGGTKLTVL | 1874 | QSADSTGTYVI | LAMBDA |
| 6.2M | COV57_mo6_HC_P1H6-p1369 | 1875 | QVQLVQSGAEVKRPGSSVKVSCQASGGTSSSYTISWVRQAPGQGLEWMGRIIPILGVANYAQKFQGGVTISADKSTGTAYMELSSLRSEDTAVYYCARETGYSGHLAVSYMDVVVGKGTTVTVSS | 1876 | ARETGYSGHLAVSYMDV | COV57_mo6_L_P1H6-p1409 | 1877 | NFMLTQPHSVSESPGKTVTISCSGSSGSIASNYVQWYQQRPGSAPTTVIYEDNQRPSGVPDRFSGSIDSSSNSASLTISGLKTEDEADYYCQSFDSNTWVFGGGTKLTVL | 1878 | QSFDSNTWV | LAMBDA |
| 6.2M | COV57_mo6_HC_P1B8-p1369 | 1879 | EVQLVQSGAEVKKPGESLNISCKASGYSFTIYWIAWVRQLPGKGLEWMGIIYPGDSDTRYSPSFQGQVTISADKSISTAYLQWRSLKASDSAVYYCARGVAVDWYFDLWGRGTLVSVSS | 1880 | ARGVAVDWYFDL | COV57_mo6_L_P1B8-p1409 | 1881 | QSVLTQPPSVSGAPGQRVTISCAGSSSNIGAGFDVYWYQQLPGTAPKLLIYGNNNRPSGVPDRFSGSKSGTSASLAITGLQAEDEADYYCQSSGSVLSDLYVFGTGTKVTVL | 1882 | QSSGSVLSDLYV | LAMBDA |
| 6.2M | COV57_mo6_HC_P1A10-p1369 | 1883 | QVQLVQSGAEVKKPGSSVKVSCKASGGSFTNHFISWVRQAPGQGLEWMGRIIPXXGTANYAQNFQGRVMMTADKSTSTAYMELSSLRSEDTAVYYCARDSGYSGYGSTYYMDVWGKGTSVTVS | 1884 | ARDSGYSGYGSTYYMDV | COV57_mo6_L_P1A10-p1409 | 1885 | QSVLTQPPSVSGAPGQRVTISCTGSNSNIGAGYDVHWYQQLPGAAPKLLIYGNNNRPSGVPDRFSGSKSDTSASLAITGLQVEDEADYYCQSYDSSLSDSVFGSGTKVTVL | 1886 | QSYDSSLSDSV | LAMBDA |
| 6.2M | COV57_mo6_HC_P1G6-p1369 | 1887 | QVQLVQSGAEVKRPGSSVKVSCQASGGTSSSYTISWVRQAPGQGLEWMGRIIPILGVANYAQKFQGGVTISADKSTGTAYMELSSLRSEDTAVYYCARETGYSGHLAVSYMDVWGKGTTVTVSS | 1888 | ARETGYSGHLAVSYMDV | COV57_mo6_L_P1G6-p1409 | 1889 | QSVLTQPPSVSGAPGQRVTFSCTGTNSNIGAGYDVHWYQQLPGTAPKLLIYGNNNRPSGVADRFSGSKSGTSASLAITGLQAEDEADYYCQSYDSSLSDSVFGGGTKLTVL | 1890 | QSYDSSLSDSV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV57_mo6_HC_P1B2-p1369 | 1891 | QVQLVQSGAEVKKPGSSVKVSCKASGGTFSSYPISWVRQAPGQGLEWMGRVIPILGITNYAEKYQGGVTISADKSTSTAYMELSRLTSEDTAVYYCARDMGYSGSGSSYYMDVWGRGTTVTVSS | 1892 | ARDMGYSGSGSSYYMDV | COV57_mo6_L_P1B2-p1409 | 1893 | QSVLTQPPSVSGAPGQRVTISCTGSSSNIGAGYDVHWYQQLPGTAPKLLIYVNTNRPSGVPDRFSGSKSGTSASLAITGLQAEDEADYYCQSYDSSLSGGVFGGGTKLTVL | 1894 | QSYDSSLSGGV | LAMBDA |
| 6.2M | COV57_mo6_HC_P2A10-p1369 | 1895 | EVQLVESGGGLVQPGGSQRLSCAASGFLFSSYWMSWVRQAPGKGLEWVANIKQDGSEKYYVDSVKGRFTISRDNAKNSLYLQMNSLRAEDTAVYFCAGSQWLRGAFEIWGQGTMVTVSS | 1896 | AGSQWLRGAFEI | COV57_mo6_L_P2A10-p1409 | 1897 | NFMLTQPHSVSESPGKTVTISCTRSSGSIAGNYVQWYQQRPGSSPTTVIYEDNQRPSGVPDRFSGSIDSSSNSASLTISGLKTEDEADYYCQSYDSSNWVFGGGTKLTVL | 1898 | QSYDSSNWV | LAMBDA |
| 6.2M | COV57_mo6_HC_P2B2-p1369 | 1899 | QVQLVQSGAEVKKPGASVKVSCKASGYTFSGYGISWVRQAPGQGLEWMGWVSAYNGNTNYAQKLQGRVTMTTDTSTSTAYMELRSLRFDDTAVYYCVGGMVAAAGWGVSAWGQGTPVIVSS | 1900 | VGGMVAAAGWGVSA | COV57_mo6_L_P2B2-p1409 | 1901 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYGSRFWVFGGGTKLTVL | 1902 | QSYGSRFWV | LAMBDA |
| 6.2M | COV57_mo6_HC_P1E8-p1369 | 1903 | QVQLQESGPGLVKPSQTLSLTCTVSGGSISSGGYFWSWIRQHPGKGLEWLGYNYYTGTPHYNPSLKSRLVISIDTSKNQFSLKLSSVTAADTAVYYCARGDTFGRGYYFDYWGQGTLVTVSP | 1904 | ARGDTFGRGYYFDY | COV57_mo6_L_P1E8-p1409 | 1905 | SYVLTQPPSVSVAPGQTARITCGGNNIGSKSVHWYQQKPGQAPVMVVYDDSDRPSGIPERFSGSNSGDTATLTISRVEAGDEADYSCQVWDRSSDHPWVFGGGTKLTVL | 1906 | QVWDRSSDHPWV | LAMBDA |
| 6.2M | COV57_mo6_HC_P1H5-p1369 | 1907 | EVQLVESGGGLVQPGGSLRLSCAASGFTFSGYVMHWVRQAPGEGLEYVSTVGGDGGSPYYANSVKGRFSISRDNSKNTLYLQMGSLRGDDTAVYFCAREKSLTGAFDIWGQGTMVTVSS | 1908 | AREKSLTGAFDI | COV57_mo6_L_P1H5-p1409 | 1909 | SYVLTQPPSVSVAPGQPARIPCGGNNIGSKSVHWYQQKPGQAPVLVVYDDSDRPSGIPERFSGSNSGNTATLTISRVEAGDEADYYCQVWDSSPDHYVFGTGTKVTVL | 1910 | QVWDSSPDHYV | LAMBDA |
| 6.2M | COV57_mo6_HC_P1D9-p1369 | 1911 | QVQLVQSGAEVKKPGASVKVSCKASGYTFTSYAMHWVRQAPGQRLEWMGWINTDNGNTKYSQKFQGRVTITRDTSASTAYMELSSLRSEDTAVYYCAREGALTNWFDPWGQGTLVTVSS | 1912 | AREGALTNWFDP | COV57_mo6_L_P1D9-p1409 | 1913 | SYVLTQPPSVSVAPGQTARIPCGGNNIGSKSVHWYQQKPGQAPVLVVYDDSDRPSGIPERFSGSNSGNTATLTISRVEAGDEADYYCQVWDSSSDLHVVFGGGTKLTVL | 1914 | QVWDSSSDLHVV | LAMBDA |
| 6.2M | COV57_mo6_HC_P1E5-p1369 | 1915 | EVQLVESGGGLVQPGRSLRLSCVASGFTFDDYAMHWVRQAPGKGLEWVSGISWNSGSIGYADSVKGRFTISRDNAKNSLYLQMNSLRAEDTALYYCAKSGGVDWTWTLHYWGQGTLVTVSS | 1916 | AKSGGVDWTWTLHY | COV57_mo6_L_P1E5-p1409 | 1917 | SYVLTQPPSVSVAPGQTARITCGGNNIGSKSVHWYQQKPGQAPVLVVYDDSDRPSGIPERFSGSNSGNTATLTISRVEAGDEADYYSQVWDTSSDHPVIFGGGTKLTVL | 1918 | QVWDTSSDHPVI | LAMBDA |
| 6.2M | COV57_mo6_HC_P2C11-p1369 | 1919 | EVQLVESGGGVVQPGGSLRLSCAASGFTVSSNFMSWVRQAPGKGLEWVSLIYNSGSTYYADSVKGRFTISRDKSKNSLYLQMNSLRAEDTAVYYCANQGYYYYMDVWGKGTPVTVSS | 1920 | ANQGYYYYMDV | COV57_mo6_L_P2C11-p1409 | 1921 | QSALTQPASVSGSPGQSITISCTGTSSDVGGYNYVSWYQHHPGKAPKLMIYDVSYRPSGVSNRFSGSKSGNTASLTISGLQSEDEADYYCSSYTSGSTPWVFGGGTKLTVL | 1922 | SSYTSGSTPWV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV57_mo6_HC_P1B9-p1369 | 1923 | EVQLVESGGGLVRPGGSLTLSCVASGFTVGSNFMSWVRQAPGKGLEWVSLIYNSGGTHYADSVKGRFTISRDRSKNTLYLQMNSLRAEDTAIYYCANHGYYYYMDVWGKGTAVTVS | 1924 | ANHGYYYYMDV | COV57_mo6_L_P1B9-p1409 | 1925 | QSVLTQPASVSGSPGQSITISCTGTGSDIGAYNYVSWHQHHPGKAPKLIIYDVSNRPSGVSNRFSGSKSGNTASLTISGLQAEDEADYYCTSYTNTTTPWVFGGGTKVTVL | 1926 | TSYTNTTTPWV | LAMBDA |
| 6.2M | COV57_mo6_HC_P1A2-p1369 | 1927 | EVQLVESGGGLVQPGGSLRLSCAASGFTFSSYSMNWVRQAPGKGLEWISYISSGSSTIHYSDSVQGRFTVSRDNAKNSLYLQMNSLRDEDTAVYYCCAARLYYHYYMDVWGKGTTVTVSS | 1928 | CAARLYHYYMDV | COV57_mo6_L_P1A2-p1409 | 1929 | QSVLTQPASVSGSPGQSITISCTGTSSDVGSYDLVSWFQQHPGKAPKLMIYEVNKRPSGVSDRFSGSKSGNTASLTIFGLQAEDEADYYCCSYVGTSIFGTGTKVTVL | 1930 | | LAMBDA |
| 6.2M | COV57_mo6_HC_P1B6-p1369 | 1931 | EVQLVESGGGLVQPGGSLRLSCEASGITFSGYSMNWVRQAPGKGLEWVSYISSGSSTVHYADSVKGRFTISRDNAKNSLYLQMNSLRVEDTAVYYCARDRRYTIGQVDHYYYAMDVWGQGTTVTVSS | 1932 | ARDRRYTIGQVDHYYYAMDV | COV57_mo6_L_P1B6-p1409 | 1933 | QSALTQPRSVSGSPGQSVTISCTGTSSDVGDYGYVSWYQQHPDKAPKLIIYDVNKWPSGVPDRFSGSKSGITASLTISGLQADDEADYYCCSYAGYYIFGTGTKVTVL | 1934 | | LAMBDA |
| 6.2M | COV57_mo6_HC_P1D4-p1369 | 1935 | EVQLVESGGGLVQPGGSLRLSCAASGIIVSNNYMSWVRQAPGKGLEWVSTIFSGGSTYYADSVKDRFTISRDNSNNTLYLQMNSLRPEDTAVYYCTRLGGYRYGMDVWGQGTTVTVS | 1936 | TRLGGYRYGMDV | COV57_mo6_K_P1D4-p1389 | 1937 | DIQMTQSPSSLSASVGDRVTITCQASQDISKYLNWYQQKPGTAPKLLIYDASELERGVPSRFSGSGSGTDFTFTIISLQPEDIATYYCLQYDNLPYTFGQGTKLQIK | 1938 | LQYDNLPYT | KAPPA |
| 6.2M | COV57_mo6_HC_P2D12-p1369 | 1939 | EVQLVESGGGLVQPGRSLKLSCVVSGFSFDDYAMHWVRQGPGKGLQWVSGLSWNSDSIGYADSVKGRFTISRDNAKNSLYLQMNSLRAEDTALYYCVKDTRAHYDILAGYNGMDVWGQGTTVTVSS | 1940 | VKDTRAHYDILAGYNGMDV | COV57_mo6_K_P2D12-p1389 | 1941 | DIVMTQSPLSLPVTPGEPASISCRSSQSLLHSNGYNYLDWYLQRPGQSPQLLIYLGSNRASGVPDRFSGSGSGTDFTLKISRVEAEDVGIYYCMQVLQTPGFGGGTKVEIK | 1942 | MQVLQTPG | KAPPA |
| 6.2M | COV57_mo6_HC_P1H11-p1369 | 1943 | EVQLVESGGNLVQPGGSLRLSCAASGVTVSSNYMTWVRQAPGKGLEWVSVIYSGGSTFYADSVKGRFTISRDNSKNTVYLQMKSLRAEDTAVYYCARDLYYYGMDVWGQGTTVTVSS | 1944 | ARDLYYYGMDV | COV57_mo6_K_P1H11-p1389 | 1945 | DIQLTQSPSFLSASVGDRVTITCRASQGISSYLAWYQQKPGKAPKLLIYAASTLQSGVPSRFSGSGSGTEFTLTISSLQPEDFATYYCQELNSYPSFGQGTKLEIK | 1946 | QELNSYPS | KAPPA |
| 6.2M | COV57_mo6_HC_P1A8-p1369 | 1947 | QVQLVESGGGVVQPGGSLRLSCVASGFEFRDYGMHWVRQAPGKGLHWVAIVQSDGKNIYYADSVKGRFTISRDNSKRSQYLQMNSLRPEDTAVYYCAKENYRGTGYLESWGQGTLVTVSS | 1948 | AKENYRGTGYLES | COV57_mo6_K_P1A8-p1389 | 1949 | DIQMTQSPSTLAASVGDTVTITCRASYDVKKWVAWYQQKPGKVPKLLIYKASTLEVGVPLRFSGSGSGTEFTLTINGLQPDDFATYYCQHFHSYPYSFGQGTKLDIK | 1950 | QHFHSYPYS | KAPPA |
| 6.2M | COV57_mo6_HC_P1E4-p1369 | 1951 | QVQLQESGPGLVKPSGTLSLTCAVSGGSISSSNWWSWVRQPPGKGLEWIGEIYHSGSTNYNPSLKSXVSMSVDKSKNQFSLKLTSVTAADTAVYYCARDYIERVFARREQGLFHYSYMDVWGRGTTVTVSS | 1952 | ARDYIERVFARREQGLFHYSYMDV | COV57_mo6_K_P1E4-p1389 | 1953 | DIQMTQSPSSLSAFVGDRVTITCRASQSISNFLNWYQHKPGEAPKVLIFGATNLQSGVPSRFRGSGSGTDFILTISSLQPEDFAVYYCQHNYINPRTFGQGTKVQIK | 1954 | QHNYINPRT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV57_mo6_HC_P2C4-p1369 | 1955 | EVQLVESGGGLVKPGGSLRLSCEVSGFTFTNAWMSWVRQAPGKGLEWVARIKNKFDGGTTDYAAPVKGRFTISRDDSKNTLYLQMNSLKTEDTAIYYCSIDLLPYKTGQYFPHWGQGTLVAVS | 1956 | SIDLLPYKTGQYFPH | COV57_mo6_K_P2C4-p1389 | 1957 | DIQMTQSPSTLSASIGDRVTITCRASESIANWLAWYQQKPGKAPKLMIYXSFNLKSGVPSRFSASGSGTEFTLTIRSLQPDDSGTYYCQHYHSYPYTFGPGPNLEI | 1958 | QHYHSYPYT | KAPPA |
| 6.2M | COV57_mo6_HC_P1B10-p1369 | 1959 | QVQLQQWGAGLLKPSETLSLTCAVFGGSFSGYYWGWIRQPPGKGLEWIAEINHSENSHYNPSLKSRVTISVDTFKNQFSLNLSSVTAADTALYYCVRRPRRYCSGDTCRGAFDIWGQGTMVTVSS | 1960 | VRRPRRYCSGDTCRGAFDI | COV57_mo6_K_P1B10-p1389 | 1961 | DIQMTQSPSSLSASVGDRVTITCRASQDISNFLAWYQQKPGKVPSLLIYAASILQPGVPSRFSGSGSGTDFTLTITSLQPEDVATYYCQKYKIDPFTFGPGTKVDIK | 1962 | QKYKIDPFT | KAPPA |
| 6.2M | COV57_mo6_HC_P1E11-p1369 | 1963 | QVQLQQWGAGLLKPSETLSLTCAVFGGSFSGYYWGWIRQPPGKGLEWIAEINHSENSHYNPSLKSRVTISVDTFKNQFSLNLSSVTAADTALYYCVRRPRRYCSGDTCRGAFDIWGQGTMVTVSS | 1964 | VRRPRRYCSGDTCRGAFDI | COV57_mo6_K_P1E11-p1389 | 1965 | DIQMTQSPSSLSASVGDRVTITCRASQDISNFLAWYQQKPGKVPSLLIYAASILQPGVPSRFSGSGSGTDFTLTITSLQPEDVATYYCQKYKIDPFTFGPGTKVDIK | 1966 | QKYKIDPFT | KAPPA |
| 6.2M | COV57_mo6_HC_P2B5-p1369 | 1967 | QVQLQQWGAGLLKPSETLSLTCAVFGGSFSGYYWGWIRQPPGKGLEWIAEINHSENSHYNPSLKSRVTISVDTFKNQFSLNLSSVTAADTALYYCVRRPRRYCSGDTCRGAFDIWGQGTMVTVSS | 1968 | VRRPRRYCSGDTCRGAFDI | COV57_mo6_K_P2B5-p1389 | 1969 | DIQMTQSPSSLSASVGDRVTITCRASQDISNFLAWYQQKPGKVPSLLIYAASILQPGVPSRFSGSGSGTDFTLTITSLQPEDVATYYCQKYKIDPFTFGPGTKVDIK | 1970 | QKYKIDPFT | KAPPA |
| 6.2M | COV57_mo6_HC_P1G8-p1369 | 1971 | EVQLVESGGGLVKPGGSLRLSCAASGFTFNTYTMNWVRQAPGKGLEWVSSIGSSGSHIYYADSLRGRFTMSRDNAKNSLYLQMNSLRAEDTAVYYCARVGPPGWLQSDYDYYGMDVWGQGTTVIVSS | 1972 | ARVGPPGWLQSDYDYYGMDV | COV57_mo6_K_P1G8-p1389 | 1973 | EIVLTQSPGTLSLSPGERATLSCRASQSISSSFLAWYQQKPGQAPRLLIYGAYSRAIGIPDRFSGSGSGTDFTLTISRLEPEDFAVYYCQQFSAFGGGTKVEIK | 1974 | QQFSA | KAPPA |
| 6.2M | COV57_mo6_HC_P2D6-p1369 | 1975 | EVQLVESGGGLVQPGGSLRLSCTASGITVSSNYMGWVRQAPGKGLEWVSIVYPGGSTFYADSVKGRFTISRDNSKNMLSLQMSRLRAEDTAVYYCARDLGDSRLDYWGQGTLVTVSS | 1976 | ARDLGDSRLDY | COV57_mo6_K_P2D6-p1389 | 1977 | DIQLTQSPSFLSASVGDRVTITCRASQGISNYLAWYQQKPGKAPKLLIYAASTLQSGVPSRFSGSGSGTEFTLAISSLQPEDFATYYCQQLNNNPPGYTFGQGTKLEIK | 1978 | QQLNNNPPGYT | KAPPA |
| 6.2M | COV57_mo6_HC_P2A11-p1369 | 1979 | QVQLQESGPGLVKPSQTLSLTCTVSGGSISSSNYYWSWIRQPAGKGLEWIGRIFSSGSTNYNPSLKSRVTISVDTSKKQFSLKLSSVTAADTAVYYCARVDSSGWYTGDTFDIWGQGTMVTVSS | 1980 | ARVDSSGWYTGDTFDI | COV57_mo6_K_P2A11-p1389 | 1981 | DIQMTQSPSSLSASVGDRVTITCRASQSINSYLNWYQHKPGKAPKLLIYAAFSLQSGVPSRFSGGGSGTDFTLTISSLQPEDFATYYCQQSFPTPPYTFGQGTKLEIK | 1982 | QQSFPTPPYT | KAPPA |
| 6.2M | COV57_mo6_HC_P2D1-p1369 | 1983 | QLQLQESGPGLVKPSETLSLTCTVSGASIPSSTSYWGWIRQPPGKGLEWIGSIYYTGSTYYNPSLKSRVTISVDTSKNHFSLILSSVTAADTAVYYCARRSITLAGRDCLDFWGQGTLVTVSS | 1984 | ARRSITLAGRDCLDF | COV57_mo6_K_P2D1-p1389 | 1985 | DIQMTQSPSSLSASVGDRLTITCRASQSITTSLNWYQQKPGKAPKLLIYAASSGVPSRFSGSGSGTDFTLAISSLQPEDFATYYCQQSYIPLLTFGGGTKVEI | 1986 | QQSYIPLLT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 6.2M | COV57_mo6_HC_P2D8-p1369 | 1987 | QVQLQQWGAGLLKPSETLSLTCAVYGGSLSAYYWSWIRQPPGKGLEWIGEINNGGTTNYNPSLKSRVTLSVDTSKNQFSLELSSVTAADTAIYYCARPGITATTGFDFWGQGSLVTVSS | 1988 | ARPGITATTGFDF | COV57_mo6_K_P2D8-p1389 | 1989 | DIQMTQSPSSLSASVGDRVTITCRASQSISTYLNWYHQKPGKAPKVLIYAASSLQGGVPSTFSGSGSGTDFTLTISSLQPDDFGTYYCQQSYNMPLTFGGGTKVEIK | 1990 | QQSYNMPLT | KAPPA |
| 6.2M | COV57_mo6_HC_P2E5-p1369 | 1991 | EVQLVESGGDLTQPGGSLRLSCAASGFTFSNYDMHWVRQATGKGLEWVSGIGTSGDTYYADSVKGRFTISRENAKNSLFLQMNHLRAGDTATYYCARIEYAWGSYRSYWYFDLWGRGTQVTVSS | 1992 | ARTEYAWGSYRSYWYFDL | COV57_mo6_K_P2E5-p1389 | 1993 | DIQMTQSPSSLSASVGDRVTITCRTSQTISTYLNWYQQKPGKAPKVLIFAASSLQSGVPSRFSGSGSGTDFTLTISSLQPEDFATYFCQQSYSAPPWTFGPGTKVEIK | 1994 | QQSYSAPPWT | KAPPA |
| 6.2M | COV57_mo6_HC_P2B6-p1369 | 1995 | EVQLVESGGGLVQPGGSLRLSCAASGFTFSSYDMHWVRQATGKGLEWVSAIGTAGDTYYPDSVKGRFTISRENAKNSLYLQMNSLRAGDTAVYYCVRDPTKSWYFDLWGRGTLVTVAS | 1996 | VRDPTKSWYFDL | COV57_mo6_K_P2B6-p1389 | 1997 | DIQMTQSPSSLSASVGDRVTITCRASQSISSYLNWYQQKPGKAPQLLIYAASSLQSGVPSRFSGSGSGTDFTLTVSSLQPEDFATYYCQQSYSTPPITFGQGTRLEIK | 1998 | QQSYSTPPIT | KAPPA |
| 6.2M | COV57_mo6_HC_P1C5-p1369 | 1999 | QVQLQQSGPGLLKPSQTLSLTCAISGDSVSSSGAAWNWIRQSPSRGLEWLGRTYYKSKWYNDYAVSVKSRITINPDTSKNQFSLQLNSVTPEDTAVYYCARMWVVAGTTDDYYYHYGMDVWGQGTTVTVSS | 2000 | ARMWVVAGTTDDYYYHYGMDV | COV57_mo6_K_P1C5-p1389 | 2001 | DIQMTQSPSSVSASVGDRVTITCRASQGISNWLAWYQQKPGKAPKVLLYAASSLRSGVPSRFSGSGSGTDFTLTISSLQPEDFATYYCQQTNTLPLSFGGGTKVEIK | 2002 | QQTNTLPLS | KAPPA |
| 6.2M | COV57_mo6_HC_P1H9-p1369 | 2003 | EVQLVESGGGLIQPGGSLRLSCAASEFIVSYNYMSWVRQAPGKGLEWVSTIYSGGSTYYADSVKGRFTISRDNSKNTLHLQMIRLRVEDTAVYYCARDRGGGILDFWGQGTLVTVSS | 2004 | ARDRGGGILDF | COV57_mo6_K_P1H9-p1389 | 2005 | DIQMTQSPSSVSASVGDRVTITCRASQGISNWLAWYQQKPGKAPKVLLYAASSLRSGVPSRFSGSGSGTDFTLTISSLQPEDFATYYCQQTNTLPLSFGGGTKVEIK | 2006 | QQTNTLPLS | KAPPA |
| 6.2M | COV57_mo6_HC_P1D2-p1369 | 2007 | EVQLVESGGGLVQPGGSLRLSCAASGFSFSSYSMNWVRQAPGKGLEWVSYIGGSGSIIYYADSVKGRFTLSRDNAKNSLSLHMHSLRAEDTAVYYCARGSGAARSYYYYGLDVWGQGTTVTVSS | 2008 | ARGSGAARSYYYYGLDV | COV57_mo6_K_P1D2-p1389 | 2009 | DIQMTQSPSSLSASVGDRVTITCRASQSINNYLNWYHQKPGKAPKLLIYATSTLQSGVPSRFSGSGSGPDFTLTISSLQPEDFATYYCQQTYSTPPTFGQGTRLEIK | 2010 | QQTYSTPPT | KAPPA |
| 6.2M | COV57_mo6_HC_P2A7-p1369 | 2011 | QVQLQQWGAGLLKPSETLSLTCAVYGGSFSGYYWSWIRQPPGKGLEWIGEINHSGSTSYSPSLKSRVTISVDTSKNQFSLKLTSVTAADTAVYYCARQRDTDMAMLFQYTGLDVWGQGTTVTVSS | 2012 | ARQRDTDMAMLFQYTGLDV | COV57_mo6_K_P2A7-p1389 | 2013 | DIQMTQSPSSLSASVGDRVTVTCRASQSITTYLNWYQQKPRKAPKLLIYAVSNLQGGVPSRFSGSGSGTFFNFTIDGLQPEDIATYYCQQTYSTPRTFGQGTKVEIE | 2014 | QQTYSTPRT | KAPPA |
| 6.2M | COV57_mo6_HC_P1B3-p1369 | 2015 | QVQLVESGGGVVQPGRSLRLSCAASGFTFRIYAMHWVRQAPGKGLEWVAIIWNDGSKQYYADSMKGRFTISRDNSKNTLYLQMNSLRDEDTALYYCAREGVALAGNGVDGFDIWGQGTMVTVSS | 2016 | AREGVALAGNGVDGFDI | COV57_mo6_K_P1B3-p1389 | 2017 | DIQMTQSPSSLSASVGDRVTITCRASQTISTFLNWYRQIPGKAPKLLIYAASSLQSGVPSRFSGSGSGTDFTLTISSLQPEDFATYYCQQTYSTPYTFGRGTKLEIK | 2018 | QQTYSTPYT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV57_ mo6_ HC_ P2C1- p1369 | 2019 | EVQLVESGGGLVQPGGSLRLSCAASGFTVSNN YMTWVRQAPGKGLGWVAVMFIGSTYYADSV KGRFTMSRDNSKNTLYLQMNSLRAEDTALYY CARGRPFRGRGAFDIWGQGTMVTVSS | 2020 | ARGRPF RGRGAF DI | COV57_ mo6_K_ P2C1- p1389 | 2021 | DIQMTQSPSSLSASVGDRVTITCQASQ DINNYLNWYQQKPGKAPKLLIYDASN LETGVPSRFSGSGSGTDFTFTISSLQPE DIATYYCQQYDNLPPLTFGGGTKVEIK | 2022 | QQ YD NLP PLT | KAPPA |
| 6.2M | COV57_ mo6_ HC_ P1B4- p1369 | 2023 | QVQLQQSGPGLVKPSQTLSLTCAISGDSVSSSG AAWNWIRQSPSRGLEWLGRTYYKSKWYNDYA VSVKSRITINPDTSKNQFSLQLNSVTPEDTAVYY CARMWVVAGTTDDYYYHYGMDVWGQGTTV T | 2024 | ARMWV VAGTTD DYYYH YGMDV | COV57_ mo6_K_ P1B4- p1389 | 2025 | DIQMTQSPSSLSASVGDRVTITCQASQ DISNYLNWYQQKPGKAPKLLIYDASN LETGVPSRFSGSGSGTDFTFTISSLQPE DIATYYCQQYDNLPYTFGQGTKLEIK | 2026 | QQ YD NLP YT | KAPPA |
| 6.2M | COV57_ mo6_ HC_ P1H8- p1369 | 2027 | EVQLVESGGGLVQPGRSLRLSCAASGFTFDDY ALHWVRQAPGKGLEWVSGISWNSASIHYADSV KGRFTISRDNAKNSLYLQMNRLRAEDTALYYC AKVRLYSTYLRGPFDIWGQGTMVTVSS | 2028 | AKVRL YSTYLR GPFDI | COV57_ mo6_K_ P1H8- p1389 | 2029 | DIQMTQSPSSLSASVGDRVTITCQASQ DIRQNLNWYQHKPGKAPKLLIYGAST LETGVPSRFSGSGSGTDFTFTISSLQPE DIAAYYCQQYDNLSPLTFGGGTKVEIK | 2030 | QQ YD NLS PLT | KAPPA |
| 6.2M | COV57_ mo6_ HC_ P1C1- p1369 | 2031 | EVQLVESGGGLIQPGGSLRLSCAASEFIVSRNY MSWVRQAPGKGLEWVSVIYSGGSTFYADSVK GRFTISRDESKNTLYLQMNSLRAEDTAIYYCAR DRGGGILDYWGQGTLVTVS | 3032 | ARDRG GGILDY | COV57_ mo6_K_ P1C1- p1389 | 2033 | DIQMTQSPSSLSASVGDRVTITCQASQ DINIFLNWYQQKPGKAPKLLIYDASSL ETGVPSRFSGSGSGTDFTFTISSLQPED FATYYCQQYGNLPKYTFGQGTNLEIK | 2034 | QQ YG NLP KYT | KAPPA |
| 6.2M | COV57_ mo6_ HC_ P1H10- p1369 | 2035 | EVQLVESGGGLIQPGGSLRLSCAASEFIVSYNY MSWVRQAPGKGLEWVSTIYSGGSTYYADSVK GRFTISRDNSKNTLHLQMIRLRVEDTAVYYCAR DRGGGILDFWGQGTLVTVSS | 2036 | ARDRG GGILDF | COV57_ mo6_K_ P1H10- p1389 | 2037 | DIQMTQSPSSLSASVGDRVTITCQASQ DINKYLNWYQQKPGKAPKLLIYDASN LEAGVPSRFSGRGSGTDFTFTISSLQPE DIATYYCQQYGNLPKYTFGQGTKLEI | 2038 | QQ YG NLP KYT | KAPPA |
| 6.2M | COV57_ mo6_ HC_ P1F4- p1369 | 2039 | QVQLQESGPGLMKPSQTLSLTCSVSGDSIRSGN NHWSWIRQPAGKGLEWIGRVYMSGDTHYNPS LKSRVTISVDTSKNHFSLKLSSVTAADTAVYYC TRGLRFLDYPVLDVWGTGTTVTVSS | 2040 | TRGLRF LDYPVL DV | COV57_ mo6_K_ P1F4- p1389 | 2041 | EIVLTQSPGTLSLSPGERATLSCRASQS VSSSYLAWYQQKPGQAPRLLIYGASS RATGIPDRFSGSGSGTDFTLTISRLEPE DFAVYYCQQYGSSLYMYTFGQGTKL | 2042 | QQ YGS SLY MY T | KAPPA |
| 6.2M | COV57_ mo6_ HC_ P2A4- p1369 | 2043 | QVQLQESGPGLVKPSETLSLTCNVSGVSISTDY WSWIRQPPGKGLEWIGYIYYSGNTKDYNPSLK SRVTISVDTSKNQFSLMLSSVTAADTAVYYCAR HYDILTSLSWFDPWGQGTLVTVSS | 2044 | ARHYDI LTSLSW FDP | COV57_ mo6_K_ P2A4- p1389 | 2045 | EIVLTQSPGTLSLSPGERATLSCRASQS ISSSYLAWYQQKPGQAPRLLIYGASIR ATGIPDRFSGRGSGTDFTLTISRLEPED FAVYYCQQYGSSLYTFGQGTKLEIK | 2046 | QQ YGS SLY T | KAPPA |
| 6.2M | COV57_ mo6_ HC_ P1A6- p1369 | 2047 | QVQLVESGGRLVKPGGSLRLSCVASGFTLSDY YMSWIRQAPGRGLEWLSYSSDGDETIYYADSV KGRFTISTDNAKNSLYLQMNSLTAEDTAVYFC ARDRGTTSSYYSYYYGMDVWGQGTSVTVSS | 2048 | ARDRGT TSSYYS YYYGM DV | COV57_ mo6_K_ P1A6- p1389 | 2049 | EIVLTQSPGTLSLSPGERATLSCRASQS VDSSDLAWYQQKPGQAPRLLIYGASS RATGVPDRFSGSGSGTDFTLTISRLEPE DFVVYYCQQYGSSPGTFGGGTRVEIK | 2050 | QQ YGS SPG T | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 1.3M | COVD57_P2_HC_F8-1369 | 2051 | QVQLQESGPGLVKPSETLSLTCTVSGGSISSYYWSWIRQPPGKGLEWIGYIHYSGSTNYNPSLKSRVTISVDTSKNQFSLKLSSVTAADTAVYYCARHYDILTALSWFDPWGQGTLVTVSS | 2052 | ARHYDILTALSWFDP | COVD57_P2_L_F8-1409 | 2053 | QSVLTQPPSVSAAPGQKVTISCSGSSSNGTIGNNYVSWYQQLPGTAPKLLIYDNNKRPSGIPDRFSGSKSGTSATLGITGLQTGDEADYYCGTWDSSLSAYWVFGGGTKLTVL | 2054 | GTWDSSLSAYWV | LAMBDA |
| 1.3M | COVD57_P2_HC_H11-1369 | 2055 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARLLSTEWLFNWFDPWGQGTLVTVSS | 2056 | ARLLSTEWLFNWFDP | COVD57_P2_L_H11-1409 | 2057 | SYVLTQPPSVSVSPGQTASITCSGDKLGDKYACWYQQKPGQSPVLVIYQDSKRPSGIPERFSGSNSGNTATLTISGTQAMDEADYYCQAWDSSTAYVFGTGTKVTVL | 2058 | QAWDSSTAYV | LAMBDA |
| 1.3M | COVD57_P1_HC_B7-1369 | 2059 | EVQLVESGGGLVQPGGSLRLSCAASGFIFSSYWMTWVRQAPGKGLEWVASIKYNGNERNYVDSVKGRFTISRDNARNSLFLQLNNLGAEDTAVYYCARQPESTIWYYFDYWGQGTLVTVSS | 2060 | ARQPESTIWYYFDY | COVD57_P1_L_B7-1409 | 2061 | SYELTQPPSVSVSPGQTARVTCSGHALPDQYTYWYQQRPGRAPVLVIYVNNQRPSGIPDRFSATTSGTTVTLTISGVQAEDEADYYCQSADSSGSYVVFGGGTKLTVL | 2062 | QSADSSGSYVV | LAMBDA |
| 1.3M | COVD57_P1_HC_F5-1369 | 2063 | EVQLVESGGGLVQPGGSLRLSCAASGFIFSSYWMTWVRQAPGKGLEWVASIKYNGNERNYVDSVKGRFTISRDNARNSLFLQLNNLGAEDTAVYYCARQPESTIWYYFDYWGQGTLVTVSS | 2064 | ARQPESTIWYYFDY | COVD57_P1_L_F5-1409 | 2065 | SYVLTQPPSVSVSPGQTARVTCSGHALPDQYTYWYQQRPGRAPVLVIYVNNQRPSGIPDRFSATTSGTTVTLTISGVQAEDEADYYCQSADSSGSYVVFGGGTKLTVL | 2066 | QSADSSGSYVV | LAMBDA |
| 1.3M | COVD57_P1_HC_H2-1369 | 2067 | EVQLVESGGGLVQPGGSLRLSCAASGFIFSSYWMTWVRQAPGKGLEWVASIKYNGNERNYVDSVKGRFTISRDNARNSLFLQLNNLGAEDTAVYYCARQPESTIWYYFDYWGQGTLVTVSS | 2068 | ARQPESTIWYYFDY | COVD57_P1_L_H2-1409 | 2069 | SYELTQPPSVSVSPGQTARVTCSGHALPDQYTYWYQQRPGRAPVLVIYVNNQRPSGIPDRFSATTSGTTVTLTISGVQAEDEADYYCQSADSSGSYVVFGGGTKLT | 2070 | QSADSSGSYVV | LAMBDA |
| 1.3M | COVD57_P1_HC_E9-1369 | 2071 | QVQLVESGGGVVQPGRSLRLSCAASGFTFNRIAMYWVRQAPGKGLEWVAVISFDGSYEYYAESVKGRFAISRDNSKNTLYLQMNSLRAEDTAVYYCAKSPMGYCTNGVCYPDSWGQGTLVTVSS | 2072 | AKSPMGYCTNGVCYPDS | COVD57_P1_L_E9-1409 | 2073 | NFMLTQPHSVSESPGKTVTISCTGSSGSIASNYVQWYQQRPGSAPTTVIYEDTQRPSGVPDRFSGSIDSSSNSASLTISGLKTEDEADYYCQSYDINSRWVFGGGTKLT | 2074 | QSYDINSRWV | LAMBDA |
| 1.3M | COVD57_P2_HC_G5-1369 | 2075 | QVQLVESGGGVVQPGRSLRLSCAASGFTFNRIAMYWVRQAPGKGLEWVAVISFDGSYEYYAESVKGRFAISRDNSKNTLYLQMNSLRAEDTAVYYCAKSPMGYCTNGVCYPDSWGQGTLVTVSS | 2076 | AKSPMGYCTNGVCYPDS | COVD57_P2_L_G5-1409 | 2077 | NFMLTQPHSVSESPGKTVTISCTGSSGSIASNYVQWYQQRPGSAPTTVIYEDTQRPSGVPDRFSGSIDSSSNSASLTISGLKTEDEADYYCQSYDINSRWVFGGGTKLT | 2078 | QSYDINSRWV | LAMBDA |
| 1.3M | COVD57_P1_HC_B4-1369 | 2079 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGVAVDWYFDLWGRGTLVTVSS | 2080 | ARGVAVDWYFDL | COVD57_P1_L_B4-1409 | 2081 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALYVFGTGTKVTVL | 2082 | QSYDSSLSALYV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD57_P1_HC_B4-1369 | 2083 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGVAVDWYFDLWGRGTLVTVSS | 2084 | ARGVAVDWYFDL | COVD57_P1_L_B4-1409 | 2085 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALYVFGTGTKVTVL | 2086 | QSYDSS | LAMBDA |
| 1.3M | COVD57_P1_HC_G8-1369 | 2087 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGVAVDWYFDLWGRGTLVTVSS | 2088 | ARGVAVDWYFDL | COVD57_P1_L_G8-1409 | 2089 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALYVFGTGTKVTVL | 2090 | QSYDSSLSLYV | LAMBDA |
| 1.3M | COVD57_P2_HC_A2-1369 | 2091 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGVAVDWYFDLWGRGTLVTVSS | 2092 | ARGVAVDWYFDL | COVD57_P2_L_A2-1409 | 2093 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALYVFGTGTKVTVL | 2094 | QSYDSSLSALYV | LAMBDA |
| 1.3M | COVD57_P2_HC_B12-1369 | 2095 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGVAVDWYFDLWGRGTLVTVSS | 2096 | ARGVAVDWYFDL | COVD57_P2_L_B12-1409 | 2097 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALYVFGTGTKVTVL | 2098 | QSYDSSLSALYV | LAMBDA |
| 1.3M | COVD57_P2_HC_B2-1369 | 2099 | EVQLVQSGAEVKKPGESLKISCKGSGYSFTSYWTGWVRQMPGKGLEWMGIIYPGDSDTRYRPAFQGQVTISADKSISTAYLQWSSLKASDTAMYYCARGVAVDWYFDLWGRGTLVTVSS | 210 | ARGVAVDWYFDL | COVD57_P2_L_B2-1409 | 2101 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALYVFGTGTKVTVL | 2102 | QSYDSSLSALYV | LAMBDA |
| 1.3M | COVD57_P2_HC_D10-1369 | 2103 | EVQLVQSGAEVKKPGESLKISCKGSGYSFTTYWIGWVRQMPGKGLEWMGIIYPADSDTRYSPSFQGQVTISADKSISTAYLQWSSLKASDTAMYYCARGVAVDWYFDLWGRGTLVTVSS | 2104 | ARGVAVDWYFDL | COVD57_P2_L_D10-1409 | 2105 | QSVLTQPPSVSGAPGQRVTISCTGSSSNIGAGYDVHWYQQLPGTAPKLLIYGYTNRPSGVPDRFSGSKSGTSASLAITGLQAEDEADYYCQSYDSSLSALYVFGTGTKVTVL | 2106 | QSYDSSLSALYV | LAMBDA |
| 1.3M | COVD57_P2_HC_E1-1369 | 2107 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGVAVDWYFDLWGRGTLVTVSS | 2108 | ARGVAVDWYFDL | COVD57_P2_L_E1-1409 | 2109 | QSVLTQPPSVSGAPGQRVTISCTGSSSNIGAGSDVHWYQQLPGTAPKLLIYGNSNRPSGVPDRFSGSKSGTSASLAITGLQAEDEADYYCQSYDSSLSALYVFGTGTKVTVL | 2110 | QSYDSSLSALYV | LAMBDA |
| 1.3M | COVD57_P1_HC_F10-1369 | 2111 | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAGFGVVITYGSGTDPLFDYWGQGTLVTVSS | 2112 | ARAGFGVVITYGSGTDPLFDY | COVD57_P1_L_F10-1409 | 2113 | QSVLTQPPSVSGAPGQRVTISCTGSNSNIGAGYDVHWYQQLPGTAPKLLIYGNSNRPSGVPDRFSGSKSGTSASLAITGLQAEDEADYYCQSYDSSLSGSRVFGGGTKLTVL | 2114 | QSYDSSLSGSRV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD57_P1_HC_H3-1369 | 2115 | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAGFGVVITYGSGTDPLFDYWGQGTLVTVSS | 2116 | ARAGFGVVITYGSGTDPLFDY | COVD57_P1_L_H3-1409 | 2117 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSRVFGGGTKLTVL | 2118 | QSYDSSLSGSRV | LAMBDA |
| 1.3M | COVD57_P2_HC_B1-1369 | 2119 | QVQLVQSGAEVKKPGSSVKVSCKASGGTFSSYTISWVRQAPGQGLEWMGRIIPILGIANYAQKFQGRVTITADKSTSTAYMELSSLRSEDTAVYYCARDSGYSGYGSTYYMDVWGKGTTVTVSS | 2120 | ARDSGYSGYGSTYYMDV | COVD57_P2_L_B1-1409 | 2121 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTVTKVTVL | 2122 | QSYDSSLSGSV | LAMBDA |
| 1.3M | COVD57_P2_HC_C10-1369 | 2123 | EVQLVQSGAEVKKPGESLKISCKGSGYSFTSYWIGWVRQMPGKGLEWMGIIYPGDSDTRYSPSFQGQVTISADKSISSAYLQWSSLKASDTAMYYCARGVAVDWYFDLWGRGTLVTVSS | 2124 | ARGVAVDWYFDL | COVD57_P2_L_C10-1409 | 2125 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVLYVFGTGTKVTVL | 2126 | QSYDSSLSVLYV | LAMBDA |
| 1.3M | COVD57_P2_HC_H12-1369 | 2127 | EVQLLESGGGLVQPGGSLRLSCAASGFTFSSYAMSWVRQAPGKGLEWVSGMSGSGGITYYADSVKGRFTISRDNSKNTLYLQMNSLRAEDTAVYYCAKDTGSMIVELLGYWGQGTLVTVSS | 2128 | AKDTGSMIVELLGY | COVD57_P2_L_H12-1409 | 2129 | QSVLTQPPSVSGAPGQRVTISCTGSSSNIGAGSDVHWYQKLPGTAPKVFIYGYNNRPSGVPDRFSGSKSGTSASLAITGLQAEDEADYYCQSYDTSLRVVFGGGTKLTV | 2130 | QSYDTSLRVV | LAMBDA |
| 1.3M | COVD57_P1_HC_C8-1369 | 2131 | EVQLVESGGGLVQPGGSLRLSCAASGFTFSSYAMHWVRQAPGKGLEYVSGISSNGGSPYYANSVKGRFTISRDNSKNTLYLQMGSLRAEDMAVYYCARGPIAAAGSYFDYWGQGTLVTVSS | 2132 | ARGPIAAAGSYFDY | COVD57_P1_L_C8-1409 | 3133 | SYVLTQPPSVSVAPGQTARITCGGNNIGSKNVHWYQQKPGQAPVLVVYDDSDRPSGIPERFSGSNSGNTATLTISRVEAGDEADYYCQVWDSSSDPHWVFGGGTKLTVL | 2134 | QVWDSSSDPHWV | LAMBDA |
| 1.3M | COVD57_P2_HC_C2-1369 | 2135 | EVQLVESGGGLVQPGGSLRLSCAASGFTFSSYAMHWVRQAPGKGLEYVSVISSNGGSTYYANSVKGRFTISRDNSKNTLYLQMGSLRAEDMAVYYCAREGPFLPSLYSSSRDAFDIWGQGTMVTVSS | 2136 | AREGPFLPSLYSSSRDAFDI | COVD57_P2_L_C2-1409 | 2137 | SYVLTQPPSVSVAPGQTARITCGGNNIGSKSVHWYQQKPGQAPVLVVYDDSDRPSGIPERFSGSNSGDTATLTISRVEAGDEADYYCQVWDSSSDPHYVFGTGTKVTV | 2138 | QVWDSSSDPHYV | LAMBDA |
| 1.3M | COVD57_P2_HC_A10-1369 | 2139 | EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDPHCSSTSCPIFYYYYMDVWGKGTTVTVSS | 2140 | TTDPHCSSTSCPIFYYYYMDV | COVD57_P2_L_A10-1409 | 2141 | SYVLTQPPSVSVAPGQTARITCGGNNIGSKSVHWYQQKPGQAPVLVVYDDSDRPSGIPERFSGSNSGNTATLTISRVEAGDEADYYCQVWDSSSDQGVFGGGTKLTVL | 2142 | QSYWDSSSDQGV | LAMBDA |
| 1.3M | COVD57_P2_HC_C4-1369 | 2143 | EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDPHCSSTSCPIFYYYYMDVWGKGTTVTVSS | 2144 | TTDPHCSSTSCPIFYYYYMDV | COVD57_P2_L_C4-1409 | 2145 | SYVLTQPPSVSVAPGQTARITCGGNNIGSKSVHWYQQKPGQAPVLVVYDDSDRPSGIPERFSGSNSGNTATLTISRVEAGDEADYYCQVWDSSSDQGVFGGGTKLTVL | 2146 | QSYWDSSSDQGV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD57_P1_HC_A9-1369 | 2147 | QVQLVQSGAEVKKPGASVKVSCKASGYTFSNYYIHWVRQAPGKGLEWMGMINPNGGTTRYPLKFQGRVTMTRDTSTRTVYMELNSLRSEDTALYFCAREIPDILEVVAATGSLDDWGQGSLVTVS | 2148 | AREIPDILEVVAATGSLDD | COVD57_P1_L_A9-1409 | 2149 | QSVLTQPPSASGSPGQSVTISCTGTRSDVGGYNYVSWYQQHPGKAPKLIIYEVTKRPSGVPDRFSGSKSGDTASLTVSGLQADDEADYFCSSYAGITNLVFGGGTKLTV | 2150 | SSYAGITNLV | LAMBDA |
| 1.3M | COVD57_P2_HC_A9-1369 | 2151 | EVQLVQSGAEVKKPGESLKISCKGSGYSFTSYWIGWVRQMPGKGLEWVGIIYPGDSDTRYSPSFQGQVTISADKSISTAYLQWSSLKASDTAMYYCARGIAVDWYFDLWGRGTLVTVSS | 2152 | ARGIAVDWYFDL | COVD57_P2_L_A9-1409 | 2153 | QSVLTQPASVSGSPGQSITISCTGTSSDIGVYNYISWSQQHPGKAPKVMIYDVTNRPSGVSNRFSGSKSGNTASLTISGLQAEDEADYYCSSYRGSSTPYVFGTGTKVTVL | 2154 | SSYRGSSTPYV | LAMBDA |
| 1.3M | COVD57_P1_HC_A5-1369 | 2155 | QVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCAREYLERYFDGGQRWISYYYMDVWGKGTAVTVSS | 2156 | AREYLERYFDGGQRWISYYYMDV | COVD57_P1_L_A5-1409 | 2157 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTPNSTLVVFGGGTKLTVL | 2158 | SSYTPNSTLVV | LAMBDA |
| 1.3M | COVD57_P1_HC_A11-1369 | 2159 | QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARDSEYSSSWYSRGYYGMDVWGQGTTVTVSS | 2160 | ARDSEYSSSWYSRGYYGMDV | COVD57_P1_L_A11-1409 | 2161 | QSVLTQPPSASGSPGQSVTISCTGTSSDVGGYNYVSWYQHHPGKAPKLMIFEVTKRPSGVPDRFSGSKSGNTASLTVSGLQAEDEADYYCYSYGGNNNAVFGGGTKLTVL | 2162 | YSYGGNNNAV | LAMBDA |
| 1.3M | COVD57_P1_HC_D12-1369 | 2163 | QVQLQQWGAGLLKPSETLSRTCAVFGGSFTNYYWSWIRQSPGKGLEWIGEINDSGITNYNPSLKSRVTISVDTSKNQFSLSLRSVTAADTAVYYCARRRSFSRPSSIDYWGQGTLVTVSS | 2164 | ARRRSFSRPSSIDY | COVD57_P1_K_D12-1389 | 2165 | DIVMTQSPLSLPVTPGEPASISCRSSQSLLHRNGYNYLDWYLQKPGQSPQLLIYLGSNRASGVPDRFRGSGSGTDFTLKISRVEAEDVGVYYCMQALQTLTFGQGTRLEIK | 2166 | MQALQTLT | KAPPA |
| 1.3M | COVD57_P2_HC_B6-1369 | 2167 | QVQLQQWGAGLLKPSETLSRTCAVFGGSFTNYYWSWIRQSPGKGLEWIGEINDSGITNYNPSLKSRVTISVDTSKNQFSLSLRSVTAADTAVYYCARRRSFSRPSSIDYWGQGTLVTVSS | 2168 | ARRRSFSRPSSIDY | COVD57_P2_K_B6-1389 | 2169 | DIVMTQSPLSLPVTPGEPASISCRSSQSLLHRNGYNYLDWYLQKPGQSPQLLIYLGSNRASGVPDRFRGSGSGTDFTLKISRVEAEDVGVYYCMQALQTLTFGQGTRLEIK | 2170 | MQALQTLT | KAPPA |
| 1.3M | COVD57_P2_HC_H7-1369 | 2171 | QVQLQQWGAGLLKPSETLSRTCAVFGGSFTNYYWSWIRQSPGKGLEWIGEINDSGITNYNPSLKSRVTISVDTSKNQFSLSLRSVTAADTAVYYCARRRSFSRPSSIDYWGQGTLVTVSS | 2172 | ARRRSFSRPSSIDY | COVD57_P2_K_H7-1389 | 2173 | DIVMTQSPLSLPVTPGEPASISCRSSQSLXHRNGYNYLDWYLQKPGQSPQLLIYLGSNRASGVPDRFRGSGSGTDFTLKISRVEAEDVGVYYCMQALQTLTFGQGTRLEIK | 2174 | MQALQTLT | KAPPA |
| 1.3M | COVD57_P1_HC_B11-1369 | 2175 | QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARDSEYSSSWYSRGYYGMDVWGQGTTVTVSS | 2176 | ARDSEYSSSWYSRGYYGMDV | COVD57_P1_K_B11-1389 | 2177 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPTFGGGTKVEIK | 2179 | MQALQTPPT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COVD57_P1_HC_F11-1369 | 2179 | QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARDSEYSSSWYSRGYYGMDVWGQGTTVTVSS | 2180 | ARDSEYSSSWYSRGYYGMDV | COVD57_P1_K_F11-1389 | 2181 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPTFGGGTKVEIK | 2182 | MQALQTPPT | KAPPA |
| 1.3M | COVD57_P2_HC_A11-1369 | 2183 | QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARDSEYSSSWYSRGYYGMDVWGQGTTVTVSS | 2184 | ARDSEYSSSWYSRGYYGMDV | COVD57_P2_K_A11-1389 | 2185 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPTFGGGTKVEIK | 2186 | MQALQTPPT | KAPPA |
| 1.3M | COVD57_P2_HC_E2-1369 | 2187 | QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARDSEYSSSWYSRGYYGMDVWGQGTTVTVSS | 2188 | ARDSEYSSSWYSRGYYGMDV | COVD57_P2_K_E2-1389 | 2189 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPTFGGGTKVEIK | 2190 | MQALQTPPT | KAPPA |
| 1.3M | COVD57_P1_HC_B8-1369 | 2191 | EVQLVESGGGLVKPGRSLRLSCTASGFTFGDYAMSWFRQAPGKGLEWVGFIRSKAYGGTTEYAASVKGRFTISRDDSKSIAYLQMNSLKTEDTAVYYCTRARSVTMVWYRYYMDVWGKGTTVTVSS | 2192 | TRARSVTMVWYRYYMDV | COVD57_P1_K_B8-1389 | 2193 | DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPYTFGQGTKLEIK | 2194 | MQSIQLPYT | KAPPA |
| 1.3M | COVD57_P2_HC_E3-1369 | 2195 | QVQLQQWGAGLLKPSETLSRTCAVYGGSFTDYYWSWIRQSPGKGLEWIGEINHSGSTNYNPFLKSRVTLSVDTSKNQFSLKLDSLTVADTAIYYCARGAKGDSDWYFDLWGRGTLVTVSS | 2196 | ARGAKGDSDWYFDL | COVD57_P2_K_E3-1389 | 2197 | EIVLTQSPATLSLSPGERATLSCRASQSVSNYLAWYQQKPGQAPRLLISDASNRATGVPDRFSGSGSGTDFTLTINSLEPEDFAVYYCQQGDNWPRMYTFGQGTKLQIK | 2198 | QQGDNWPRMYT | KAPPA |
| 1.3M | COVD57_P1_HC_F9-1369 | 2199 | EVQLVESGGGLVQPGGSLRLSCAASGFTVSSNYMSWVRQAPGKGLEWVSVIYSGGSTYYADSVKGRFTISRDNSKNTLYLQMNSLRAEDTAVYHCARDLAVYGMDVWGQGTTVTVSS | 2200 | ARDLAVYGMDV | COVD57_P1_K_F9-1389 | 2201 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPVTFGQGTRLEIK | 2202 | QQLNSYPPVT | KAPPA |
| 1.3M | COVD57_P1_HC_F3-1369 | 2203 | QVQLQESGPGLVKPSETLSLTCTVSGASINSYYWTWIRQPPGKGLEWIGYIHDSGNTNYNPALRSRVTISLDTSKNQFSLKVRSVTAADTAVYYCAREVVVQSAKDWSHYYYYMDVWGKGTTVSVSS | 2204 | AREVVVQSAKDWSHYYYMDV | COVD57_P1_K_F3-1389 | 2205 | EIVLTQSPATLSLSPGERASLSCRASQSVGTYLAWYQQKVGQPPRLLIYDASNRATGIPARFSGSGSGTDFTLTISSLDPEDFAVYYCQQRSSWFVTFGQGTRLEIK | 2206 | QQRSSWFVT | KAPPA |
| 1.3M | COVD57_P1_HC_B11-1369 | 2207 | QVQLQESGPGLVKPSETLSLTCTVSGASINSYYWTWIRQPPGKGLEWIGYIHDSGNTNYNPALRSRVTISLDTSKNQFSLKVRSVTAADTAVYYCAREVVVQSAKDWSHYYYYMDVWGKGTTVSVSS | 2208 | AREVVVQSAKDWSHYYYMDV | COVD57_P2_K_B11-1389 | 2209 | EIVLTQSPATLSLSPGERASLSCRASQSVGTYLAWYQQKVGQPPRLLIYDASNRATGIPARFSGSGSGTDFTLTISSLDPEDFAVYYCQQRSSWFVTFGQGTRLEIK | 2210 | QQRSSWFVT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 1.3M | COVD57_ P2_ HC_ D11- 1369 | 2211 | QVQLQESGPGLVKPSETLSLTCTVSGASINSYY WTWIRQPPGKGLEWIGYIHDSGNTNYNPALRS RVTISLDTSKNQFSLKVRSVTAADTAVYYCARE VVVQSAKDWSHYYYYMDVWGKGTTVSVSS | 2212 | AREVV VQSAK DWSHY YYYMD V | COVD57_ P2_K_ D11- 1389 | 2213 | EIVLTQSPATLSLSPGERASLSCRASQS VGTYLAWYQQKVGQPPRLLIYDASNR ATGIPARFSGSGSGTDFTLTISSLDPED FAVYYCQQRSSWFVTFGQGTRLEIK | 2214 | QQ RSS WF VT | KAPPA |
| 1.3M | COVD57_ P2_ HC_ F10- 1369 | 2215 | QVQLQESGPGLVKPSETLSLTCTVSGASINSYY WTWIRQPPGKGLEWIGYIHDSGNTNYNPALRS RVTISLDTSKNQFSLKVRSVTAADTAVYYCARE VVVQSAKDWSHYYYYMDVWGKGTTVSVSS | 2216 | AREVV VQSAK DWSHY YYYMD V | COVD57_ P2_K_ F10- 1389 | 2217 | EIVLTQSPATLSLSPGERASLSCRASQS VGTYLAWYQQKVGQPPRLLIYDASNR ATGIPARFSGSGSGTDFTLTISSLDPED FAVYYCQQRSSWFVTFGQGTRLEIK | 2218 | QQ RSS WF VT | KAPPA |
| 1.3M | COVD57_ P2_ HC_ A6- 1369 | 2219 | QVQLQESGPGLVKPSETLSLTCTVSGGSMTSYY WNWIRHTPGKDLEWIGYIDYSGNTNYNPSLRS RGTISVDTSKNQFSLRVTSVTAADTAVYYCARE VVVSSPKDWSHYYYYMDVWGKGTTVTVSS | 2220 | AREVV VSSPKD WSHYY YYMDV | COVD57_ P2_K_ A6- 1389 | 2221 | EIVLTQSPATLSLSPGERATLSCRASQS VSTYLTWYQQKPGQAPRLLIYDASNR ATGIPARFSGSGSGTDFTLTITSLEPEDF ALYYCQQRSTWFVTFGQGTRLEIK | 2222 | QQ RST WF VT | KAPPA |
| 1.3M | COVD57_ P1_ HC_ G3- 1369 | 2223 | EVQLVESGGGLVQPGGSLRLSCAASGFNFSTH WMHWVRQAPGKGLVWVSRINSDGSRRAYATS VKGRFTISRDNAKNTLYLQMDSLRDEDTAVYY CTRDDSSWPHFFDNWGQGTLVTVSS | 2224 | TRDDSS WPHFFD N | COVD57_ P1_K_ G3- 1389 | 2225 | DIQMTQSPSSLSASVGDRVTITCRASQQQS SIINYLNWYQQKPGKAPKLLIYTASSL QSGVPSRFSGSGSGTDFTLTISSLQPED FATYFCQQSYSSPLWTFGQGTKVEIK | 2226 | QQS YSS PL WT | KAPPA |
| 1.3M | COVD57_ P2_ HC_ C12- 1369 | 2227 | EVQLVESGGGLVQPGGSLRLSCAASGFTFSSYD MHWVRQATGKGLEWVSAIGTAGDTYYPGSVK GRFTISRENAKNSLYLQMNSLRAGDTAVYYCA RGTTFNHYYYMDVWGKGTTVTVSS | 2228 | ARGTTF NHYYY MDV | COVD57_ P2_K_ C12- 1389 | 2229 | DIQMTQSPSSLSASVGDRVXITCRASQ SISSYLNWYQQKPGKAPKLLIYAASSL QSGVPSRFSGSGSGTDFTLTISSLQPED FATYYCQQSYSTPPWTFGQGTKVEIK | 2230 | QQS YST PPW T | KAPPA |
| 1.3M | COVD57_ P1_ HC_ B9- 1369 | 2231 | QVQLQQWGAGLLKPSETLSLTCAVYGGSFSGY YWSWIRQPPGKGLEWIGEVNHSGSTNYNPSLK SRVTISVDTSKNQFFLKLSSVTAADTAVYYCAR HWMPRDYYYYGMDVWGQGTTVTVSS | 2232 | ARHWM PRDYYY YGMDV | COVD57_ P1_K_ B9- 1389 | 2233 | DIQMTQSPSSLSASVGDRVTITCRASQQQS SISSYLNWYQQKPGKAPKLLIYAASSL QSGVPSRFSGSGSGTDFTLTISSLQPED FATYYCQQSYSTPRTFGQGTKVEIK | 2234 | QQS YST PRT | KAPPA |
| 1.3M | COVD57_ P1_ HC_ H10- 1369 | 2235 | QVQLQQWGAGLLKPSETLSRTCGVYGGSFRDY YWSWIRQSPGKGLEWIGEINHSGSTNYNPSLLG RVTISVDTSKNQFSLRLTSVTAADTAVYYCARA YVSSVSEDYFDYWGQGTLVTVSS | 2236 | ARAYVS SVSEDY FDY | COVD57_ P1_K_ H10- 1389 | 2237 | DIQMTQSPSSLSASVGDRVTITCRASQQQS SISTYLNWYQQKPGKAPELLIYAASSF QSGVPSRFSGSGSGTDFTLTIRSLEPED SATYYCQQSYTTPYTFGQGTKLEIK | 2238 | QQS YTT PYT | KAPPA |
| 1.3M | COVD57_ P1_ HC_ C3- 1369 | 2239 | EVQLVESGGGLVQPGGSLRLSCAASGFTVSSNY MSWVRQAPGKGLEWVSVIYSGGSTYYADSVK GRFTISRDNSKNTLYLQMNSLRAEDTAVYYCA RDGEGQRETDYWGQGTLVTVSS | 2240 | ARDGE GQRETD Y | COVD57_ P1_K_ C3- 1389 | 2241 | DIQMTQSPSSLSASVGDRVTITCQASQ DISNYLNWYQQKPGKAPKLLIYDASN LETGVPSRFSGSGSGTDFTFTISSLQPE DIATYYCQQYDNLPRTFGQGTKVEIK | 2242 | QQ YD NLP RT | KAPPA |
| 1.3M | COVD57_ P2_ | 2243 | EVQLVESGGGLVQPGGSLRLSCAASGFNFSTH WMHWVRQAPGKGLVWVSRINSDGSRRAYATS | 2244 | TRDDSS WPHFFD | COVD57_ P2_K_ | 2245 | EIVMTQSPATLSVSPGERATLSCRASQ SVSSNLAWYHQKPGQAPRLLIYGAST | 2246 | QQ YD | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | HC_B7-1369 | | VKGRFTISRDNAKNTLYLQMDSLRDEDTAVYYCTRDDSSWPHFFDNWGQGTLVTVSS | | N | B7-1389 | | RATGIPARFSGSGSGTEFTLTISSLQSEDFAVYYCQQYDNWPLFGQGTRLEIK | | NWPL | |
| 1.3M | COVD57_P2_HC_E11-1369 | 2247 | EVQLVESGGGLVKPGGSLRLSCAASGLTFTAYRMNWVRQAPGKGLEWLSSISNTNGDIYYADSVKGRFTISRDNAKNSLYLQMNSLRADDTAVYYCARDVASNYAYFDLWGQGTLVTVSS | 2248 | ARDVASNYAYFDL | COVD57_P2_K_E11-1389 | 2249 | EIVMTQSPATLSLSPGERATLSCRASQSVSSNLAWYHQKPGQAPRLLIYGASTRATGIPARFSGSGSGTEFTLTISSLQSEDFAVYYCQQYDNWPLFGQGTRLEIK | 2250 | QQYDNWPL | KAPPA |
| 1.3M | COVD57_P1_HC_E6-1369 | 2251 | QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAANHCSGGSCYDGFDIWGQGTMVTVSS | 2252 | AANHCSGGSCYDGFDI | COVD57_P1_K_E6-1389 | 2253 | EIVLTQSPGTLSLSPGERATLSCRASQSQQVSSSYLAWYQQRPGQAPRLLIYGASSRATGIPDRFSGSGSGTDFTLTISRLEPEDFAVYYCQQYGSSPWMFGQGTKVEIK | 2254 | QQYGSSPWM | KAPPA |
| 1.3M | COVD57_P2_HC_H6-1369 | 2255 | QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAPYCSGGSCNDAFDIWGQGTMVTVSS | 2256 | AAPYCSGGSCNDAFDI | COVD57_P1_K_H6-1389 | 2257 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 2258 | QQYGSSPWT | KAPPA |
| 1.3M | COVD57_P2_HC_C3-1369 | 2259 | EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDVGADSSSAYYYYYMDVWGKGTTVTVSS | 2260 | TTDVGADSSSAYYYYYMDV | COVD57_P2_K_C3-1389 | 2261 | EIVLTQSPXSLSLSPGERATLSCGASQSVSSSYLAWYQQKPGLAPRLLIYDASSRATGIPDRFSGSGSGTDFTLTISRLEPEDFAVYYCQQYGSSPYTFGQGTKLEIK | 2262 | QQYGSSPYT | KAPPA |
| 1.3M | COVD57_P2_HC_G11-1369 | 2263 | EVQLVQSGPVLVKPGPSVKISCKASGFTFTDYYMHWVKQSHGKSLEWIGLVYPYNGGTSYNQKFKGKATLTVDTSSSTAYMELNSLTSEDSAVYYCARSGPDYFDYWGQGTTLTVSS | 2264 | ARSGPDYFDY | COVD57_P2_K_G11-1389 | 2265 | EIVMTQSPATLSVSPGERATLSCRASQSVSSNLAWYQQKPGQAPRLLIYGASTRATGIPARFSGSGSGTEFTLTISSLQSEDFAVYYCQQYNNWPRTFGGGTKVEIK | 2266 | QQYNNWPRT | KAPPA |
| 6.2M | COV072_6mo_P4_IGG_17-P1369 | 2267 | QVQLVQSGAEVKKPGSSVKVSCKASGGTFSSYAISWVRQAPGQGLEWMGGIIPIFGTANYAQKFQGRVTITADESTSTAYMELSSLRFEDTAVYYCARDPSGSYPHNWFDPWGQGTLVTVSS | 2268 | ARDPSGSYPHNWFDP | COV072_6mo_P4_Lambda_17-P1409 | 2269 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVFGGGTKLTVL | 2270 | QSYDSSLSGV | LAMBDA |
| 6.2M | COV072_6mo_P4_IGG_1-P1369 | 2271 | QVQLQQWGAGLLKPSETMSLTCDVSGGSFSGYYWSWIRQPPGKGLEWIGDINHSGSTNYNASLKSRVSILVDTSKNQFSLKLSSVTAADTAVYYCARCYDVLTGLMDVWGQGTTVTVSS | 2272 | ARCYDVLTGLMDV | COV072_6mo_P4_Lambda_1-P1409 | 2273 | SYVLTQPPSVSVAPGKTARITCGGDYIGSKNVHWYQQKPGQAPVLVISYDTDRPSGIPERLSGSNSGNTATLTISRVEAGDEADYYCQVWDSTTGHPGVVFGGGTKLTVL | 2274 | QVWDSTTGHPGVV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV072_6mo_P4_IGG_24-P1369 | 2275 | QVQLQESGPGLVKPSQTLSLTCTVSGGSISSSNYYWSWIRQHPGKGLDWIGYIFYSGSTYYNPSLKSRLTIAVDTSENQFSLKLSSVTAADTAVYYCARICRSTSCFYGAFDIWGQGTMVTVSS | 2276 | ARICRSTSCFYGAFDI | COV072_6mo_P4_Lambda_24-P1409 | 2277 | QSVLTQPASVSGSPGQSITISCTGTSSDVGSYNLVSWYQQHPGKAPKLIIYEVTKRPSGVSNRFSGSKSGNTASLTISGLQAEDEADYYCCSYARIITLFGGGTKLTX | 2278 | CSYARIITL | LAMBDA |
| 6.2M | COV072_6mo_P4_IGG_38-P1369 | 2279 | QLQLQESGPGLVKPSETLSLTCTVSGGSISSSNYYWGWIRQPPGKGLEWIGNIYYSGITYYIPSLKSRVTISVDTSKNQFSLKLSSVTAADTALYYCARFDRYCSSTICYAFDGWGQGTLVTVST | 2280 | ARFDRYCSSTICYAFDG | COV072_6mo_P4_Lambda_38-P1409 | 2281 | QSVLTQPASVSGSPGQSITISCTGTSSDIGSYDFVSWYQQHPGKAPKLMVYEVNKRPSGISNRFSGSKSGNTASLTISGLQAEDEADYHCCSYAGTTTLFGGGTKVTVL | 2282 | CSYAGTTTL | LAMBDA |
| 6.2M | COV072_6mo_P4_IGG_43-P1369 | 2283 | QVQLQESGPGLVKPSGTLSLICAVSGGSISSNKWWSWVRQSPGKGLEWIGEIFHNGNTNYNPSLKSRVTISIDKSKNQFSLKLNSVTAADTAVYYCTRVMLGFGEFDYWGQGTLVTVSS | 2284 | TRVMLGFGEFDY | COV072_6mo_P4_Lambda_43-P1409 | 2285 | QSVLTQPASVSGSPGQSITISCTGTSSDVGTYNYVSWYQQHPGKAPKLILYDVSDRPSGVSNRFSGSKSGNTASLTISGLQAEDEADYYCSAYTGSSPLYVFGGGTKVTV | 2286 | SAYTGSSPLYV | LAMBDA |
| 6.2M | COV072_6mo_P4_IGG_45-P1369 | 2287 | EVQLVQSGAEVKKPGESLRISCKGSGYTFTNYWISWVRQMPGKGLEWMGTITLIDSDTNYSPSFQGLVTISDDRSSSTAYLQWSSLKTSDTAMYYCARHSQGYNYGAWYYSGLHVWGQGTTVTVSS | 2288 | ARHSQGYNYGAWYYSGLHV | COV072_6mo_P4_Lambda_45-P1409 | 2289 | QSVLTQPPSASATPGQRVTVSCSGSSSNIGSNTVNWYQHLPETAPKLLIYSNNQRPSGVPDRFSGSKSGTSASLAISGLQSEDEADYYCEAWDDSVLGPVFGGGTKLTVL | 2290 | EAWDDSVLGPV | LAMBDA |
| 6.2M | COV072_6mo_P4_IGG_50-P1369 | 2291 | EVQLLESGGGLVQPGGSLRLSCADSGFSFSTYGMSWVRQAPGKGLEWVSTISGSGDNTYHADSVKGRFTISRDNSKNTLYLQMNSLRAEDTAVYYCAKNIAEMSTFDDYFYYYGMDVWGQGTTVTVSS | 2292 | AKNIAEMSTFDDYFYYYGMDV | COV072_6mo_P4_Lambda_50-P1409 | 2293 | SYVLTQPPSVSVSPGQTASITCSGDKLGDKYACWYQQKPGQSPVMVIYQDTKRPSGIPERFSGSNSGNTATLTISGTQAMDEADYYCQAWDSSTFYVFGTGTKVTVL | 2294 | QAWDSSTFYV | LAMBDA |
| 6.2M | COV072_6mo_P4_IGG_53-P1369 | 2295 | QVQLVESGGGVVQPGRSLRLSCAASGFTFSNYAMHWVRQAPGKGLEWVAVISNDGSSKHYGDSVKGRFTNSRDNSKNTVFLQMNSLRAEDTAVYYCAREVSGTYEKDYFDYWGQGTLVAVS | 2296 | AREVSGTYEKDYFDY | COV072_6mo_P4_Lambda_53-P1409 | 2297 | SYVLTQPPSVSVAPGKTASITCGGDGSKSVHWYQQKPGQAPVLVIYYDTDRPSGIPERFSGSNSGNTATLTISRAEAGDEADYYCQVWDSSPDHYVFGTGTRVTVL | 2298 | QVWDSPDHYV | LAMBDA |
| 6.2M | COV072_6mo_P4_IGG_58-P1369 | 2299 | QVQLQESGPGLVKPSQSLSLTCTVSGVSISSGDYYWSWIRQHPGKGLEWIGYIFYSGITYYNPSLKSQVIISVDTSKNQFSLKLSSVTAADTAVYYCARFSRLLGANWFDPWGQGTLVTVSS | 3000 | ARFSRLLGANWFDP | COV072_6mo_P4_Lambda_58-P1409 | 3001 | QSVLTQPRSVSGSPGQSVTISCTGTSSDVGSYDYVSWYQQHPGKAPKLMIYDVTKRPSGVPDRFSGSKSGNTASLTISGLQAEDEADYYCCSYVGTVLFGGGTKLTVL | 3002 | CSYVGTVL | LAMBDA |
| 6.2M | COV072_6mo_P4_IGG_6-P1369 | 2303 | QVQLVESGGGVVQPGRSLRLSCAASGFTFNSYGMHWVRQAPGKGLEWVAVIWYDGSNEYYADSVKGRITISRDNSKNTLYLQMNSLRAEDTAVYYCARDPLRDILTGYHYKYYYMDVWGKGTTVTVSS | 2304 | ARDPLRDILTGYHYKYYYMDV | COV072_6mo_P4_Lambda_6-P1409 | 2305 | QSVLTQPPSASATPGQRVTISCSGSSSNIGSDTVNWYQQLPGTAPKLLIYSNDQRPSGVPDRFSGSKSGTSASLAISGLQSEDEADYYCSTWDDGLNGVVFGGGTKLTVL | 2306 | STWDDGLNGVV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV072_6mo_P4_IGG_73-P1369 | 2309 | QVQLQESGPGLVKPSGTLSLTCAVSAGSISSNNWWSWVRQPPGKGLEWIGEVYHNGNINYNPSLKSRVTLSVDKSKNQFSLKLSSVTAADTAVYYCAKGGDRAMGPEYFDSWGQGTLVTVSS | 2308 | AKGGDRAMGPEYFDS | COV072_6mo_P4_Lambda_73-P1409 | 2309 | QSVLTQPASVSGSPGQSITISCTGTSSDVGANNYVSWYQQHPGKAPKLMIYDVNERPSGVSNRFSGSKSGNTASLTISGLQTEDEADYYCSSFASSSTLLFGGGTKLTVL | 2310 | SSFASSSTLL | LAMBDA |
| 6.2M | COV072_6mo_P4_IGG_80-P1369 | 2311 | QVQLQESGPGLVKPSQTLSLTCAVSGVSINSGDYYWTWIRQHPGKGLEWIGYIYYSGVTYYNPSLKSRVTISVDTSKSQFSLKLSSVTAADTATYYCARVARSFYDSSGYYPGAFDIWGQGTMVTVSS | 2312 | ARVARSYYPGAFFYDSSGDI | COV072_6mo_P4_Lambda_80-P1409 | 2313 | QSVLTQPASVAGSPGQSVTISCTGTSSDVGSYDLVSWYQQHPGKAPKLMIFEVSKRPSGVSPRFSASKSGNTASLTISGLQPEDEADYYCCSYAPSYTSFGGGTKLTVL | 2314 | CSYAPSYTS | LAMBDA |
| 6.2M | COV072_6mo_P4_IGG_94-P1369 | 2315 | QVQLVQSGAEVKRPGASVKVSCKTSGYTFTNYYIHWVRQAPGQGLEWVGMINPDGGSTSTAQKFQGRVTMTADTSTSTVYMELSSLRSEDAAVYFCARDFFLIPAQAGFDYWGQGTLVTVSS | 2316 | ARDFFLIPAQAGFDY | COV072_6mo_P4_Lambda_94-P1409 | 2317 | QSVLTQPASVSGSPGQSITISCTGTNSDVGSYNLVSWYQQHPGKAPKLMIYEVTKRPSGVSNRFSGSKSGHTASLTISGLQAEDEADYYCCSYASSRTWVFGGGTKLTVL | 2318 | CSYASSRTWV | LAMBDA |
| 6.2M | COV072_6mo_P4_IGG_9-P1369 | 2319 | EVQLVESGGGLVQPGGSLRLSCSASGFTFSTYSMHWVRQAPGKGLEYVSAISNNGGSTYYADSVKGRFTISRDNSKNTLYLQMSSLRAEDTAVYYCVTWELNDYWGQGTLVTVSS | 2320 | VTWELNDY | COV072_6mo_P4_Lambda_9-P1409 | 2321 | QSVLTQPASVSGSPGQSITISCTGTSSDVGGYYSVSWYQQHPGKAPKLMIYDVTNRPSGVSDRFSGSKSGNTASLTISGLQAEDEADYYCSSFTTSTTRVFGGG | 2322 | SSFTTSTTRV | LAMBDA |
| 6.2M | COV072_6mo_P5_IGG_10-P1369 | 2323 | EVQLVESGGALVQPGGSLRLSCAASGFTFSSYSMNWVRQAPGKGLEWISYISRSSGSIYYADSVKGRFTISRDNAKISLYLQMNSLRAEDTAVYYCARMRGSTYDGEDYFDLWGQGTLVTVSS | 2324 | ARMRGSTYDGEDYFDL | COV072_6mo_P5_Lambda_10-P1409 | 2325 | SYVLTQPPSVSVAPGQTARITCGGNNIGSKSVHWYQQKPGQAPVLVIYYDSDRPSGIPERFSGSNSGNTATLTIRRVEAGDEADYYCQVWDGSSDLPWVFGGGTKLTVL | 2326 | QVWDGSSDLPWV | LAMBDA |
| 6.2M | COV072_6mo_P5_IGG_12-P1369 | 2327 | QVQLQESGPGLVKPSQTLSLTCTVSGGSISSGDYYWSWIRQPPGQGLECIGYIYYRGSTYYNPSLKSRVTMSVDTSKNQFSLNLTSVTAADTAARVRYCSGSSCLDNNWFDPWGQGTLVTVSS | 2328 | ARVRYCSGSSCLDNNWFDP | COV072_6mo_P5_Lambda_12-P1409 | 2329 | QSVLTQPPSVSGAPGQRVTISCTGSSSNIGTGYGVHWYQRLPGTAPKLLIYGNSNRPSGVPDRFSGSRSGTSASLAITGLQAEDEGDYYCQSYDSSLSDVLFGG | 2330 | QSYDSSLSDVL | LAMBDA |
| 6.2M | COV072_6mo_P5_IGG_13-P1369 | 2331 | QVQLQESGPGLVKPSGTLSLSCTVTGGSISSNNWWSWVRQSPVKGLEWIGEIYHNGNINYNPSLKSRVTMSIDKSKNHFSLKLSSVTAADTAARGDVLDWFDPWGQGTLVTVS | 2332 | ARGDVLDWFDP | COV072_6mo_P5_Lambda_13-P1409 | 2333 | QSALTQPASVSGSPGQSITFSCTGTSSDVGAYNYISWYQQHPGKAPKLMIYDIGVNNRPSGVSRRFSGSKSGNTASLTISGLQSEDEADYFCSSYAGNSTVRFGGGTKLTVL | 2334 | SSYAGNSTVR | LAMBDA |
| 6.2M | COV072_6mo_P5_IGG_19-P1369 | 2335 | QVQLVESGGGVVQPGRSLRLSCAASGFTFSSYAIHWVRQAPGKGLEWVAVISFDGSNKYYRDSVKGRFTISRDNGKNTLYLQMNSLRAEDTAVYYCAKAALGYCTNGVCYCDNWGQGTLVTVSS | 2336 | AKAALGYCTNGVCYCDN | COV072_6mo_P5_Lambda_19-P1409 | 2337 | NFMLTQPHSVSESPGKTVTISCTGSSGSIASNYVQWYQQRPGSAPTTVIYEDNQRPSGVPDRFSGSIDSSSNSASLSISGLKTEDEADYYCQSYDINSLWVFGGGTRLTVL | 2338 | QSYDINSLWV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV072_6mo_P5_IGG_1-P1369 | 2339 | QVQLQESGPGLVKPSGTLSLTCAVSGGSINSTHWWSWVRQPPGKGLEWIGEIHHGGNTNYNPSLKSRATISVDRSKNQFSMKLTSVNAADTAVYYCARDTWSMGAGPWGQGTLVTVSS | 2340 | ARDTWSMGAGP | COV072_6mo_P5_Lambda_1-P1409 | 2341 | QSALTQPASVSGSPGQSITISCTGTSSDVGAYNYVSWYQQHPGEAPKLIIYDVSDRPSGVSNRFSGSKSGNTASLTISGLQAEDEADYHCSSYTSSSTLFGGGTKVTVL | 2342 | SSYTSSTL | LAMBDA |
| 6.2M | COV072_6mo_P5_IGG_29-P1369 | 2343 | QVQLQESGPGLVKPSQTLSLTCSVSGGSISSGNYYWSWIRQRPGKGLEWIGNIFYSGITYYNPSLKSPVTISVDTSKSQFSLKLTSVSAADTAVYYCARLCRFAADSTNCYSAFDIWGQGTMVTVSS | 2344 | ARLCRFAADSTNCYSAFDI | COV072_6mo_P5_Lambda_29-P1409 | 2345 | QSVLTQPASVSGSPGQSITISCTGTSSDVGSYDLVSWYQQHPGKAPKLMIYEVSKRPSGISSRFSGSKSGNTASLTISGLQAEDEADYYCCSYTGNVVFGGGTKLTVL | 2345 | CSYTGNVV | LAMBDA |
| 6.2M | COV072_6mo_P5_IGG_34-P1369 | 2347 | QVQLQESGPGLVKPSQTLSLACTVSGGSISGGAYYWSWIRQHPGKGLEWIGYIYYSANTYYNPSLQSRVTISVDTSKKQFSLKLTSVTAADTAIYYCAGFDVSYYDAFDIWGQGTMVTVSS | 2348 | AGFDVSYYDAFDI | COV072_6mo_P5_Lambda_34-P1409 | 2349 | QSVLTQPRSVSGSPGQSVTISCTGTSSDVGVYNYVSWYQQHPGKAPKLIISNVHKRPSGVPDRFSGSKSGNTASLTISGLQAEDEAEYYCCSYAGSYVYVFGTGTTVTVL | 2350 | CSYAGSYVYV | LAMBDA |
| 6.2M | COV072_6mo_P5_IGG_49-P1369 | 2351 | EVQLVESGGGLVQPGGSLRLSCAASGFTFSNFWMSWVRQPPGKGLEWVANINQDGSDEYFVGSVKGRFTISRDNAKNSLYLQMNNLRVEDTAVYYCARDQDVLVVGGTPEAFDIWGQGTMVTVSS | 2352 | ARDQDVLVVGGTPEAFDI | COV072_6mo_P5_Lambda_49-P1409 | 2353 | SYVLTQPPSVSVSPGQTARITCSGDALPRQYVYWYQQRPGQAPVLVIYKDTERPSGIPERFSGSTSGTTVTLTISGVQADDEADYYCQSADSRGQVFGGGTKLTVL | 2354 | QSADSRGQV | LAMBDA |
| 6.2M | COV072_6mo_P5_IGG_50-P1369 | 2355 | QLQLQESGPGLVKPSETLSLTCSVSGGSISSSNYYWVWIRQPPGKGLEWIGSIYYSGTTYYNPSLKSRVTISVDTSKNQFSLKVDTVTAADTAVYYCARLVRRFDFWEPPGGFDPWGQGTLVTVSS | 2356 | ARLVRRFDFWEPPGGFDP | COV072_6mo_P5_Lambda_50-P1409 | 2357 | QSVLTQPASVSGSPGQSITISCTGTSSDVGSYDLVSWYQHHPGKAPKLMIYEVTKRPSGVSNRFSGSKSDNTASLTISGLQAEDEADYFCCSYVGSSTVLFGGGTKLTVL | 2358 | CSYVGSSTVL | LAMBDA |
| 6.2M | COV072_6mo_P5_IGG_51-P1369 | 2359 | QLQLQESGPGLVKPSETLSLTCSVSGGSLSNTAYYWGWIRQPPGKGLEWIGSIYYSGNTYSNPSLKSRVTMSADRSKNQFSLKLSSVTAADTAVYYCLSGNYLPYSSLDYWGQGTLVTVSS | 2360 | LSGNYLPYSSLDY | COV072_6mo_P5_Lambda_51-P1409 | 2361 | QSVLTQPASVSASPGQSITMSCTGTSSDVGTYNLVSWYQQHPGKAPKLLMFEVNKRPSGVSDRFSGSKSGNTASLTISGLQAEDEADYHCCSYAGNSTWVFGGGTKVTVL | 2362 | CSYAGNSTWV | LAMBDA |
| 6.2M | COV072_6mo_P5_IGG_58-P1369 | 2363 | QVQLVESGGGVVQPGKSLRLSCAASGFTFASFAMHWVRQAPGKGLEWVSSFDGSNKYYADSVKGRFTISRDNSKNTVHLQMTSLRAEDTALYFCARGDYYGSGTYFNPLPNFDYWGQGSLVTVSS | 2364 | ARGDYYGSGTY | COV072_6mo_P5_Lambda_58-P1409 | 2365 | QSVLTQPPSASGTPGQRVTISCSGSSSNIGTYPVNWYQYLPGTAPKLLIYSNNQRPSGVPDRFSGSKSGTSASLAISGLQSEDEADYFCAAWDDSLNVFWVFGGGTKLTVL | 2366 | AAAWDDSLNVFWV | LAMBDA |
| 6.2M | COV072_6mo_P5_IGG_74-P1369 | 2367 | QVQLVQSGAEVKKPGASVKVSCKASGYSFANYYMHWVRQAPRQGLEWIGIVNPSDGSTTYAQKFQGRVTITRDTSTSTVYMQVSSLKSDDTAVYYCARPKWELQPSGGYHYYQMDLWGRGTTVTVSS | 2368 | ARPKWELQPSGGYHYYQMDL | COV072_6mo_P5_Lambda_74-P1409 | 2369 | QSVLTQPPSVSAAPGQNVTISCSGSTSNILFYYVSWYQHLPGTAPKLLIFDSNNRPSGIPDRFSGSKSGTSATLRITGLQTGDEADYYCGTWDSGLTAPVFGGGTKLTV | 2370 | GTWDSGLTAPV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 6.2M | COV072_6mo_P5_IGG_79-P1369 | 2371 | QVQLVQSGAEVKKPGASVKVSCKTSGYTFTNYGISWVRQAPGQGLEWMGWISGFNGNTKYAQKVQGRVTMTTDASTSTAYMELRSLRSDDTAVYYCARVMGIIVTGPTYWGQGTLVTVSS | 2372 | ARVMGIIVTGPTY | COV072_6mo_P5_Lambda_79-P1409 | 2373 | NFMLTQPHSVSESPGKTVTISCTGSSGSIASNYVQWYQQRPGSAPTTVIYEDNQRPSGVPDRFSGSIDSSSNSASLTISGLKTEDEADYSCQSYDGSTWVFGGGTKLTVL | 2374 | QSYDGSTWV | LAMBDA |
| 6.2M | COV072_6mo_P5_IGG_88-P1369 | 2375 | QVQLQESGPGLVKPSQTLSLSCTVSGGSISSDDYYWSWIRQPPGKGLEWIGYIYYSGSTYYNSSLKSRVSISVDTSKNQFSLKLSSVTAADTAVYYCARWKRWLQFLYFDYWGQGTLVTVSS | 2376 | ARWKRWLQFLYFDY | COV072_6mo_P5_Lambda_88-P1409 | 2377 | QSALTQPRSVSGSPGQSVTISCTGTSSDVGGYSFVSWYQQHPGKAPKVLIYDVDKRPSGVPDRLSGSKSGNTASLTISGLQAEDEADYYCCSYAGSYTLIFGGGTKLTVL | 2378 | CSYAGSYTLI | LAMBDA |
| 6.2M | COV072_6mo_P5_IGG_8-P1369 | 2379 | QVQLVESGGGVVQPGRSLRLSCAASGFTFSTFGMHWVRQAPGKGLEWVAAIRYDGSDKYYVDSVKGRFTISRDNSKNALYLQMNSLRDEDTAVYYCAREDYYDSSGSFDYWGQGTLVTVSS | 2380 | AREDYYDSSGSFDY | COV072_6mo_P5_Lambda_8-P1409 | 2381 | QSVLTQPRSVSGSPGQSVTISCTGTSSDVGGYNYVSWYQQHPGKAPKVMTYDVSKRPSGVPDRFSGSKSGNTASLTISGLQAEDEADYYCCSYAGRSWVFGGGTKLTVL | 2382 | CSYAGRSWV | LAMBDA |
| 6.2M | COV072_6mo_P5_IGG_90-P1369 | 2383 | QLQLQESGPGLVKPSETLSLTCSVSGGSISSSSYYWGWIRQPPGKGLEWIGNIFYSGITYYNPSLKSRVTISVDTSKNQFSLKLSSVTAADTAVYYCARLPREYSSSSVYLVFDIWGQGTMVTVSS | 2384 | ARLPREYSSSSVYLVFDI | COV072_6mo_P5_Lambda_90-P1409 | 2385 | QSVLTQPASVSGSPGQSITISCTGTSSDVGSYDLVSWYQQHPDKAPKLMIYEVSKRPSGISNRFSGSKSGNTASLTISGLQAEDEADYYCFSYVGSNILFGGGTKLTVL | 2386 | FSYVGSNIL | LAMBDA |
| 6.2M | COV072_6mo_P5_IGG_93-P1369 | 2387 | QLQLQESGPGLVKPSETLSLTCTVSGGSISSSSYYWGWIRQPPGKGLEWIGSIFYSGSTYYKPSLRSRVTISVDTSKNQFSLKLSSVTAADTAVYYCARLARSFYDSSGYYPGAWYWGQGTLVTVSS | 2388 | ARLARSFYDSSGYYPGAWY | COV072_6mo_P5_Lambda_93-P1409 | 2389 | QSVLTQPASMSGSPGQSITISCTGTSSDVGSYDLVSWYQQHPGKAPKLFIYEVAKRPSGVSYRFSGSKSGNTASLTISGLQAEDEADYYCCCYVGNNTMFGGGTKLTV | 2390 | CCYVGNNTM | LAMBDA |
| 6.2M | COV072_6mo_P5_IGG_9-P1369 | 2391 | QVQLVQSGAEVKKPGASVKVSCKASGYSFATYYIHWVRQAPGQGLEWMGIIDPSGGSTNYAQKFQGRVTMTRDTSTSTVYLELSSLRSEDTAVYYCARADTPIVVDTTSYFYYMDVWGKGTTVTVSS | 2391 | ARADTPIVVDTTSYFYYMDV | COV072_6mo_P5_Lambda_9-P1409 | 2393 | QSVLTQPASVSGSPGQSITISCTGTSRDIGFYKYVSWYQQHPGKAPKLIIYDVTNRPSGVSNRFSGSKSGNTASLTISGLQAEDEAHYHCSSYSTAYVHVLFGGGTRLTVL | 2394 | SSYSTAYVHVL | LAMBDA |
| 6.2M | COV072_6mo_P4_IGG_10-P1369 | 2395 | EVQLVESGGGLVQPGGSLRLSCAASGFSVSTNYMSWVRQAPGKGLEWVSIIYRGDSTSYADSVKGRFTISRDSSKNTLFLQMNSLRAEDTAVYYCARDRSGYSYGLIHGMDVWGQGTTVTVSS | 2396 | ARDRSGYSYGLIHGMDV | COV072_6mo_P4_kappa_10-P1389 | 2397 | DIQMTQSPSSLSASVGDRVTITCRASESISNYLNWYQQKPGKAPKLLISAASNLQRGVPSRFSGSGSGTDFTLTISSLQPEDFATYYCQQSYSSPPVYTFGQGTKLEIK | 2398 | QQSYSSPPVYT | KAPPA |
| 6.2M | COV072_6mo_P4_IGG_13-P1369 | 2399 | QVQLQQWGAGLLKPSETLSRTCAVYGGSFSGYYWSWFRQSPGKGLEWIGEINHSGSTNYNPSLKNRVTISVDTSKNQFSLMLSSVTAADTAVYYCARGGFGVVINYYYSGMDVWGRGTTVTVSS | 2400 | ARGGFGVVINYYYSGMDV | COV072_6mo_P4_kappa_13-P1389 | 2401 | DIVMTQSPLSLPVTPGEPASISCRSSQSLLHSNGYNYLDWYLQKSGQSPQLLIYLGSNRASGVPDRFSGSGSGTDFTLKISRVEAEDVGVYYCMQALQTPPTFGQGTKVEIK | 2402 | MQALQTPPT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV072_6mo_P4_IGG_14-P1369 | 2403 | QVQLVESGGGVVQPGRSLRLSCAASGFTFSNYVMYWVRQAPGKGLEWVAIILYDGSDPNYADSVKGRFTISRDNSKNTLYLQMNSPRAEDTAVYYCAKGQDPYCAAGSCYSHYFDYWGQGTLVTVSS | 2404 | AKGQDPYCAAGSCYSHYFDY | COV072_6mo_P4_kappa_14-P1389 | 2405 | EIVLTQSPATLSLSPGERATLSCRASHSVSTYLAWYQQKFGQAPRLLIYDASNRATGIPARFSGSGSGTDFTLTISSLEPEDFAVYYCQQRNNWPTFGQGTRLEI | 2406 | QQRNNWPT | KAPPA |
| 6.2M | COV072_6mo_P4_IGG_15-P1369 | 2407 | EVQLVQSGAEVKKPGESLRISCKGSGYSFTNYWISWVRQMPGKGLEWMGRIDPSDSYTTYNPSFQGHVTISADKSISTAYLRWSSLKASDTAIYYCARIGAHYLHYMDVWGKGTTVTVSS | 2408 | ARIGAHYLHYMDV | COV072_6mo_P4_kappa_15-P1389 | 2409 | EIVMTQSPATLSVSPGERATLSCRASRSVSTNLAWYQQKPGQAPRLLIYGASTRATGIPARFSGSGSGTEFTLTISSLQSEDFVVYYCQHYNNWPLFGGGTKVEIK | 2410 | QHYNNWPL | KAPPA |
| 6.2M | COV072_6mo_P4_IGG_18-P1369 | 2411 | QVQLVQSGAEVKKPGASVKVSCKTSGYTFISYYIHWVRQAPGQGLEWMGIINPDGDNTNYAQKFQGRVTMTRDTSTSTVYMELSSLRFEDTAVYYCARGGAIPALRTAFDIWGQGTMVTVSS | 2412 | ARGGAIPALRTAFDI | COV072_6mo_P4_kappa_18-P1389 | 2413 | DIQMTQSPSTLSASVGDRVTITCRASQSISNWLAWYQQKPGKAPKLLIYKASSLESGVPSRFSGSGSGTEFTLTISSLQPDDFATYYCQEYNSYYFGQGTKLEIK | 2414 | QEYNSYY | KAPPA |
| 6.2M | COV072_6mo_P4_IGG_20-P1369 | 2415 | QVQLVQSGAEVKKPGASVKVSCRASGYTFTSYGINWVRQAPGQGLEWMGWISTYEGDTNYAQKLQGRVTMTTDTSTNTAYMELRSLRSDDTAVYYCATVTGNYLSDYWGQGTLVTVSS | 2416 | ATVTGNYLSDY | COV072_6mo_P4_kappa_20-P1389 | 2417 | EIVMTQSPATLSVSPGETATLSCRASQSNLAWYQHKPGQAPRLLIYGASTRATGIPARFSGSGSGTEFTLTISSLQSEDFAVYYCQYYDNWPPEFTFGPGTKVDIK | 2418 | QYYDNWPPEFT | KAPPA |
| 6.2M | COV072_6mo_P4_IGG_26-P1369 | 2419 | QVQLVQSGAEVKKPGSSVKVSCKASGGTFSSYVINWVRQAPGQGLEWMGRIMPILDVATYTQKFQGRVTITADKSTSTAYMELSSMRFDDTAVYYCARGVIAATPGYFDIWGQGTMVTVSS | 2420 | ARGVIAATPGYFDI | COV072_6mo_P4_kappa_26-P1389 | 2421 | EIVMTQSPATLSVSPGERATLSCRASQSISNNLAWYQQKPGQSPRLLVYGASTRATGIPARFSGSGSGTEFTLTISSLQSEDFAVYYCQQYNNGLTFGGGTKVEIK | 2422 | QQYNNGLT | KAPPA |
| 6.2M | COV072_6mo_P4_IGG_27-P1369 | 2423 | QVQLVQSGAEVKKPGASVKVSCKASGYTFTSYYIHWVRQAPGQGLEWMGIINADAGSITYAQKFQGRVTMTRDTSTSTVYMDLSSLRSEDTAVYYCARGGAIPVPRGASDYWGQGTLVTVSS | 2424 | ARGGAIPVPRGASDY | COV072_6mo_P4_kappa_27-P1389 | 2425 | DIQMTQSPSTLSASVGDTITITCRASQSISTWLAWFQQKPGKAPKVLIYRASSLESEVPSRFSGSGSGTEFTLTITSLQPDDFASYYCQQYNSYPWTFGQGTKVEIK | 2426 | QQYNSYPWT | KAPPA |
| 6.2M | COV072_6mo_P4_IGG_28-P1369 | 2427 | EVQLVESGGGLVQPGGSLRLSCAASEITVSSNYMTWVRQAPGKGLEWVSVMYSGGSTFYADSVKGRFTISRDNSKNTLYLQMKSLRVEDTAVYYCARDLYYYGMDVWGQGTTVTVSS | 2428 | ARDLYYYGMDV | COV072_6mo_P4_kappa_28-P1389 | 2429 | DIQLTQSPSFLSASVGDRVTITCRASQGISNYLAWYQQKPGKAPKLLIYAASTLQSGVPSRFSGSGSGTEFTLTISSLQPEDFATYYCQQVDSYPLFGQGTRLEIK | 2430 | QQVDSYPL | KAPPA |
| 6.2M | COV072_6mo_P4_IGG_29-P1369 | 2431 | EVQLVESGGGLVQPGGSLRLSCAASGFTFSSYDMHWVRQGTGKGLEWVSVIGTAGDAYYPGSVKGRFTISRENAKNSLYLQMNSLRAGDTAVYYCARMVYDSSGFKGYFDLWGRGTLVTVS | 2432 | ARMVYDSSGFKGYFDL | COV072_6mo_P4_kappa_29-P1389 | 2433 | DIQMTQSPSSLSASVGDRVTITCRASQSISSYLNWYQQKPGKAPKLLIYAASSLQSGVPSRFSGSGSGTDFTLTISNLQPEDFATYYCQQSYSTSMYTFGQGTKLEIK | 2434 | QQSYSTSMYT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV072_6mo_P4_IGG_2-P1369 | 2435 | QVQLVQSGAEVKKPGASVEVSCKASGNTFTNHYIHWVRQAPGQGLEWMGIINPWGASTSYAQRFQGRVTMTRDTSTTTDTSTTTVYMEMTSLISEDTAVYYCARGPPPRPIGFLESLSPEDAFGGLDVWGQGTTVTVSS | 2436 | ARGPPPRPIGFLESLSPEDAFGGLDV | COV072_6mo_P4_kappa_2-P1389 | 2437 | DIQMTQSPSSLSASVGDRVTITCQASQDISNYLNWYQQKPGKAPKLLIYDASNLETGVPSRFSGGGSGTDFTFTISSLQPQDIATYYCQQYDNLPLTFGGGTKVEIK | 2438 | QQYDNLPLT | KAPPA |
| 6.2M | COV072_6mo_P4_IGG_30-P1369 | 2439 | QVQLQESGPGLVKPSETLSLTCTVSGGSISSSYWNWIRQSPGKGLEWIGYIYYDGYTTFNPSLKSRVTISVDTSKNQFSLKLSSVTAADTAFYYCAAGLKGRSSSWYEYWGQGTLVTVSS | 2440 | AAGLKGRSSSWYEY | COV072_6mo_P4_kappa_30-P1389 | 2441 | DIQMTQSPSSLSASVGDRVTITCRASQSISSYLNWYQQKPGKAPKLLIYATSSLQSGVPSRFSGSGSGTDFTLTITSLQPEDFATYYCQQTYSSPHTFGQGTKLEIK | 2442 | QQTYSSPHT | KAPPA |
| 6.2M | COV072_6mo_P4_IGG_32-P1369 | 2443 | EVQLVETGGGLIQPGGSLRLSCAVSGFTVSANYMIWVRQAPGKGLEWVSMIYPGGSTFYADSVKGRFSISRDNSKDTLHLQMNSLRAEDTAVYYCARHQVGFEWGQGTLVTVSS | 2444 | ARHQVGFE | COV072_6mo_P4_kappa_32-P1389 | 2445 | DIQMTQSPSSLSASVGDRVTITCQASQDIRNYLNWYQQKPGKAPKVLIYDATNLEAGVPSRFSGSGSGTDFTFTISSLQPEDIATYFCHQYDNLPITFGQGTRLEIK | 2446 | HQYDNLPIT | KAPPA |
| 6.2M | COV072_6mo_P4_IGG_34-P1369 | 2447 | EVQLVESGGGLVQPGGSLRLACAASEIIVSTNYMNWVRQAPGKGLEWVSVIYSGGSTFYADSVKGRFTISRDNSKNTLYLQMNSLRVEDTAVYYCARETYGMDVWGQGTTVTVSS | 2448 | ARETYGMDV | COV072_6mo_P4_kappa_34-P1389 | 2449 | DIQLTQSPSFLSASVGDRVTITCRASQGISSYLAWYQQKPGKAPKLLIYSASTLQSGVPSRFSGSGSGTEFTLTISSLQPEDLATYYCQQLNSSPQKGTFGQGTKVEIK | 2450 | QQLNSSPQKGT | KAPPA |
| 6.2M | COV072_6mo_P4_IGG_35-P1369 | 2451 | EVQLVQSGAEVKKHGESLRISCKGSGYSFTNYYITWVRQMPGKGLEWMGRIDPRDSYTNYSPSFQGHVTISVDKSISTAYLQWSRLKAADTAIYYCARHGSGYLEPTNHYYYYGMDVWGQGTTVTVSS | 2452 | ARHGSGYLEPTNHYYYYGMDV | COV072_6mo_P4_kappa_35-P1389 | 2453 | EIVLTQSPGTLSLSPGERATLSCRASQSVSSIYLAWYKPGQAPRLLIYGASSRATGIPDRFSGSGSGTDFTLTISRLEPEDFAVYYCQQYGSSFGQGTKLEIK | 2454 | QQYGSS | KAPPA |
| 6.2M | COV072_6mo_P4_IGG_3-P1369 | 2455 | QVQLQESGPGLVKPSGTLSLTCAVSGGSISSSNWWSWVRQPPGKGLEWIGEIYNSGSTNYNPSLKSRVTILVDKSKNQFSLKLSSVTAADTAVYYCAGSYSNYIGGVWFDPWGQGTLVTVSS | 2456 | AGSYSNYIGGVWFDP | COV072_6mo_P4_kappa_3-P1389 | 2457 | EIVLTQSPATLSLSPGERATLSCRASQSVSTYLAWYQQKPGQAPRLLIYDASNRATGIPARFSGSGSGTDFTLTISSLEPEDFAVYYCQQRNNWLTFGGGTKVEIK | 2458 | QQRNNWLT | KAPPA |
| 6.2M | COV072_6mo_P4_IGG_44-P1369 | 2459 | EVQLVQSGAEVKKPGESLKISCKVSGYSFISYWIGWVRQMPGKGLEWMGIIYPYDSDTRYSPSFQGQVTISADKSINTAYLQWSSLKASDTAIYYCARHVTWGLGYFMDVWGKGTTVTVSS | 2460 | ARHVTWGLGYFMDV | COV072_6mo_P4_kappa_44-P1389 | 2461 | DIQMTQSPSSLSASVGDRLTITCRASHSIGSSLNWYQHKPGKAPKLLIYAASSLQSGVPSRFSGSGSGTDFTLTISSLQPEDFATYFCQQSYSTPLTVGGGTTVEIK | 2462 | QQDYSTPLT | KAPPA |
| 6.2M | COV072_6mo_P4_IGG_4-P1369 | 2463 | EVQLVESGGGLIQPGGSLRLSCAAPGLIVSRNYMSWVRQAPGKGLEWVSIIYPGGSSYYADSVKGRFTISRDSSKNTLFLQMNFLRADDTAVYYCVRPMVRGIRDMDVWGKGTSVTVSS | 2464 | VRPMVRGIRDMDV | COV072_6mo_P4_kappa_4-P1389 | 2465 | DIQMTQSPSSLSASVGDRVTITCQATQDINTYLNWYQQKPGKAPKLLIYDASNLETGVPSRFSGSGSGTDFTFTISSLQPEDIATYYCHQYDNLPLTFGGGTKVEIK | 2466 | HQYDNLPLT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV072_6mo_P4_IGG_52-P1369 | 2467 | EVQLVESGGGLVQPGGSLRLSCAASEFIVTRNYMSWVRQAPGKGLEWVSLIYPGGSTFYADSVKGRFTISRDNSKNTLFLHMNSLRAEDTAVYYCARDLAGRLDYWGQGTLVTVSS | 2468 | ARDLAGRLDY | COV072_6mo_P4_kappa_52-P1389 | 2469 | DIQMTQSPSSLSASVGDRVTITCQASQDINNFLNWYQQKPGKAPKLLIYDASNLETGVPSRFSGSGSGTDFTFTISSLQPEDIAIYYCQQYDSLSRLTFGGGTK | 2470 | QQYDSLSRLT | KAPPA |
| 6.2M | COV072_6mo_P4_IGG_56-P1369 | 2471 | EVQLVESGGGLVQPGGSLRLSCAGSGFTVSSNYMNWVRQAPGKGLEWVSTIYSGGSSFYADSVKGRFTISRDNSKNTLYLQMDSLRGEDTAVYYCARDKLQRGGPDWGQGTLVTVSS | 2472 | ARDKLQRGGPD | COV072_6mo_P4_kappa_56-P1389 | 2473 | DIQMTQSPSSLSASVGDRVTITCQASQDTNNYLNWYQQKPGKAPKLLIYDASNLETGVPSRFSGSRSGTDFTFTISSLQPEDIATYYCHQYDNLPQTFGQGTKLEIK | 2474 | HQYDNLPQT | KAPPA |
| 6.2M | COV072_6mo_P4_IGG_59-P1369 | 2475 | QVQLVQSGAEVKKPGASVKVSCKSSGYTFTSYAISWIRQAPGQGLEWLGWINTFNGDTNFPQKLQGRVTMTTDTSTSTAYMELRSLRSDDTAMYYCARVGDYYYGSGTTYYFDYWGQGTLVTVSS | 2476 | ARVGDYYYGSGTTYYFDY | COV072_6mo_P4_kappa_59-P1389 | 2477 | DIQMTQSPSSVSASVGDRVTITCRASQGISTSLAWYQQKPGKAPKLLTSLQSGVPSRFSGSGSGTDFTLTISSLQPEDFATYYCQQADNFPPLFTFGPGTKVEIK | 2478 | QQADNFPPLFT | KAPPA |
| 6.2M | COV072_6mo_P4_IGG_62-P1369 | 2479 | EVQLVESGGDLVQPGGSLRLSCAASGFSFSTYNMNWVRQAPGKGLEWVLYISSSSDTIYYADSVKGRFTISRDNAKNSLYLQMNSLRAEDTAVYYCARHSGSSSYYYYGMDVWGQGTTVTVSS | 2480 | ARHSGSSSYYYYGMDV | COV072_6mo_P4_kappa_62-P1389 | 2481 | DIQMTQSPSSLSASVGDRVTITCRASQNIYSYLNWYQQKPGKAPKLLIYGVSSLQSGVPSTFSGSGSGTDFTLTISSLQPEDFATYYCQQSYSTPPTFGGGTKVDIK | 2482 | QQSYSTPPT | KAPPA |
| 6.2M | COV072_6mo_P4_IGG_63-P1369 | 2483 | EVQLVESGGGLVQPGGSLRLSCAASGFTLSHNYMSWVRQAPGKGLEWVSVIYSGGRTYYADSVKDRFTISRDNSKNTLYLQMNSLRAEDTAVYYCARDLSDGEGPWGQGTLVTVSS | 2484 | ARDLSDGEGP | COV072_6mo_P4_kappa_63-P1389 | 2485 | AIQMTQSPSSLSASVGDRVTITCRASQDIRHALGWFHQKPGEAPKLLIYAASNLQSGVPPRFSGSGSGTDFTLTISSLQPEDFATYYCLQDYNYPRTFGQGTRVEIK | 2486 | LQDYNYPRT | KAPPA |
| 6.2M | COV072_6mo_P4_IGG_66-P1369 | 2487 | EVQLVESGGGLVQPGESLKLSCSASGFTFNNYGMHWVRQAPGKGLEYLSSISSDGGSTTYADSVKGRFTISRDNSKNTLYFQMSSLRTEDTAVYYCVKGDIPYCSGDCYGNAFDIWGQGTMVTVSS | 2488 | VKGDIPYCSGDCYGNAFDI | COV072_6mo_P4_kappa_66-P1389 | 2489 | DIQMTQSPSSLSTSVGDRVTITCQASQDISNSLNWYQQRPGKAPKLLIYDASNLETGVPSRFSGSGSGTYFTFTISSLQPEDIATYYCQQYDNLPPGYTFGQGTKLEIK | 2490 | QQYDNLPPGYT | KAPPA |
| 6.2M | COV072_6mo_P4_IGG_68-P1369 | 2491 | QVQLVESGGGVVQPGRSLRLSCAASGFTFTTYGMHWLRQVPGKGLEWVAVIWYDGSNQYYADSVKGRFTISRDNSKNTLYLQMNSLRAEDTAVYYCARDIGIVVVEIDYWGQGTLVTVSS | 2492 | ARDIGIVVVEIDY | COV072_6mo_P4_kappa_68-P1389 | 2493 | DVVMTQSPLSLPVTLGQPASISCRSSQSLVYIDENTYLHWFQQRPGQSPRRLIYKVSNRDSGVPDRFSGSGSGTDFTLKISRVEAEDVGVYXCMQGTHWPYTFGQGTKLEIK | 2494 | MQGTHWPYT | KAPPA |
| 6.2M | COV072_6mo_P4_IGG_70-P1369 | 2495 | QMQLVQSGPEVKKPGTSVKVSCKASGFTFSSSAVQWVRQARGQRLEWIGWIVVGSGNTNYAQKFQERVTITRDMSTSTAYMELSSLRSEDTAVFYCAAPYCNVTTCFDGFNIWGRGTMVTVS | 2496 | AAPYCNVTTCFDGFNI | COV072_6mo_P4_kappa_70-P1389 | 2497 | EIVLTQSPGTLSLSPGERATLSCRASQSVRSSYFAWYQQKPGQAPRLLIYAASSRATGIPDRFSGSGSGTDFTLTISRLEPEDFALYYCQQYGSSPWTFGQGTKVEIK | 2498 | QQYGSSPWT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV072_6mo_P4_IGG_71-P1369 | 2499 | EVQLVESGGGLVQPGGSLRLSCAATEITVSSNYMTWVRQAPGKGLEWVSVIYPGGSTFYADSVKGRFSISRDNSKNTLYLQMNSLRAEDTAVYYCARDLVVYGLDCWGQGTLVTVSS | 2500 | ARDLVVYGLDC | COV072_6mo_P4_kappa_71-P1389 | 2501 | DIQLTQSPSFLSASVGDRVTITCRASQGISSYLAWYQQKPGKAPKLLIYAASTLQSGVPSRFSGSGSGTEFTLTISSLQPEDFATYYCQQLNTYPPPFGGGTKVEIK | 2502 | QQLNTYPPP | KAPPA |
| 6.2M | COV072_6mo_P4_IGG_77-P1369 | 2503 | EVQLVESGGGLVQPGGSLRLSCAASGIVVSSNYMSWVRQAPGKGLEWVSLLYSGGSTFYADSVKGRFTISRDNSKNTLYLQMNSLRADDTAVYYCARDLVVRGLDVWGQGTTVTVSS | 2504 | ARDLVVRGLDV | COV072_6mo_P4_kappa_77-P1389 | 2505 | DIQLTQSPSFLSASVGDRVTITCRASQGISSDLAWYQQKPGKAPKLLIYAASTLQSGVPSRFSGSGSETEFTLTISSLQPEDFATYYCQQLNSDLCAFGQGTRLEIK | 2506 | QQLNSDLCA | KAPPA |
| 6.2M | COV072_6mo_P4_IGG_82-P1369 | 2507 | QVQLVQSGAEVRKPGSSVKVSCKASGGPFDQYTFSWVRQAPGQGLEWMARITPVVDLTNYAQKFQGRITIITDKSTSTAYMELSSLRSEDTAIYYCATPLNDYYASGNLGLWGQGTRVTVSS | 2508 | ATPLNDYYASGNLGL | COV072_6mo_P4_kappa_82-P1389 | 2509 | GISYYLAWFQQKPGEAPRSLIYDASSLQSGVPSKFSGSGSGTDFTLTISSLQPEDSATYYCQQYNSYPLTFGGGTKLEIK | 2510 | QQYNSYPLT | KAPPA |
| 6.2M | COV072_6mo_P4_IGG_84-P1369 | 2511 | EVQLVQSGAEVKKPGESLKISCKGSGDSFPSYWIGWVRQMPGKGLEWMGIIYPDDSETIYSPSFQGQVTISTDKSISTAYLQWSSLKASDTAIYYCARRGYHYYGMDVWGQGTTVTVSS | 2512 | ARRGYHYYGMDV | COV072_6mo_P4_kappa_84-P1389 | 2513 | DIQMTQSPSTLSASVGDRVTITCRASQSISSWLAWYQQKPGKAPKLLIYKASSLESGVPSRFSGSGSGTEFTLTITSLQPDDFATYYCQQYNSYLGTFGQGTKVE | 2514 | QQYNSYLGT | KAPPA |
| 6.2M | COV072_6mo_P5_IGG_28-P1369 | 2515 | EVQLVQSGAEVKKPGESLRISCKASGYNFPSYWISWVRQMPGKGLEWMGRIDPSDSSTNYSPSFQGHVTVSVDKSITTAYLQWSSLKASDTAMYFCARTGGGYYNWFDPWGQGTLVTVSS | 2516 | ARTGGGYYNWFDP | COV072_6mo_P5_kappa_28-P1389 | 2517 | DIQMTQSPSSLSASVGDRVTITCRASQNIGSYLNWYQQTPGKVPKLLIYAASTLHSGVPSRFSGSESGTHFTLTISSLQPEDFATYFCQQSYSSPPTFGQGTKVEIK | 2518 | QQSYSSPPT | KAPPA |
| 6.2M | COV072_6mo_P5_IGG_2-P1369 | 2519 | QVQLVQSGAEVKKPGASVKVSCKASGFSFTIYYIHWVRQAPGQGLEWMGIINPDAGSIGYAQNFQGRVTMTRDTSTSTVYMELTSLRSEDTAVYFCARGALLPAADAFDIWGQGTMVTVSS | 2520 | ARGALLPAADAFDI | COV072_6mo_P5_kappa_2-P1389 | 2521 | EIVMTQSPATLSVSPGERATLSCRASQGVSSNLAWYQQKPGQAPRLLIYGASTRATGIPARFSGSGSGTEFTLTISSLQSEDSAVYYCQQYSNWPPLYTFGQGT | 2522 | QQYSNWPPLYT | KAPPA |
| 6.2M | COV072_6mo_P5_IGG_31-P1369 | 2523 | QMQLVQSGPEVKKPGTSVKVSCKASGFTFGSSAVQWVRQARGQRLEWIGWIVVGSGNTDYAQRFQERVTITRDMSTNTVYMELSSLRFEDTAVYYCAAVYCSGTTCHDAFDIWGRGTMVTASS | 2524 | AAVYCSGTTCHDAFDI | COV072_6mo_P5_kappa_31-P1389 | 2525 | DIQMTQSPSSLXASVGDRVTITCQATQDIRKYLNWFRRKLEKAPKLLIYDASTLDTRVPSRFSGNRSATDFTFTICSLQPEDNARYSCQQSDTLPPLGGDTPDTFGHGTKLEIK | 2526 | QQSDTLPPLGGDTPDT | KAPPA |
| 6.2M | COV072_6mo_P5_IGG_32-P1369 | 2527 | QVQLVQSGAEVKKPGASVKVSCKASGNTFMTYYIHWVRQAPGQGPEWMGIMNPSGGSTTYAQKFQGRLTMTRDTSKSTVYLELSSLRSEDTAVYFCARGGIVPDASEPFDIWGQGTMVTVSS | 2528 | ARGGIVPDASEPFDI | COV072_6mo_P5_kappa_32-P1389 | 2529 | DIQMTQSPSTLSASVGDRVTITCRASQSISAWLAWYQQKPGKAPKLLIYKASSLESGVPSRFSGSGSGTDFTLTISSLQPDDFATYYCQHYKSDSPYTFGQGTKLEIK | 2530 | QHYKSDSPYT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV072_6mo_P5_IGG_38-P1369 | 2531 | QVQLVQSGAEVKKPGASVKVSCKASRNTFTNYYIHWVRQAPGQGLEWLGIINPDAGSTTYAQKFQGSVIMTRDTSTSTVYMELASLRSEDTAVYYCARDFAGIPATSYFEYWGQGTLVTVSS | 2532 | ARDFAGIPATSYFEY | COV072_6mo_P5_kappa_38-P1389 | 2533 | EIVLTQSPATLSLSPGERATLSCRASQSVSNYLAWYQQKPGQAPRLLIYDASNRATGIPARFSGSGSGTDFTLTISSLEPEDFAIYYCQHRTNWPPMYTFGQGTKLEIK | 2534 | QHRTNWPPMYT | KAPPA |
| 6.2M | COV072_6mo_P5_IGG_43-P1369 | 2535 | EVQLVESGGGLVQPGGSLRLSCEASGITVSSNYMIWVRQAPGKGLEWVSVIYSGGSTFYADSVKGRFTISRDDSRNTLFLQMSSLRAEDTAVYYCARDLVVYGADYWGQGTLVTVSS | 2536 | ARDLVVYGADY | COV072_6mo_P5_kappa_43-P1389 | 2537 | DIQLTQSPSFLSASVGDRVTITCRASQGISNYLAWYQQKPGKAPKLLIYTASTLQNGVPSRFSGSGSGTEFTLTISSLQPK | 2538 | QQLDTYPPP | KAPPA |
| 6.2M | COV072_6mo_P5_IGG_45-P1369 | 2539 | QVQLVQSGAEVKKPGSSVKVSCKASGGTFNNYAIGWVRQAPGQGLEWMGTTIPIFGAANSPQKFQGRVTITADESMSTVYMELSSLRSEDTALYYCARAALYCSGGSCYRYYFDYWGQGTLVTVSS | 2540 | ARAALYCSGGSCYRYYFDY | COV072_6mo_P5_kappa_45-P1389 | 2541 | DIQMTQSPSTLSASVGDRVTITCRASQSISGWLAWYQQKPGKAPKLLIYKASTLQTGVPSRFSGSGSETEFTLTISSLQPDDFATYYCQQYNTYSTFGPGTKVEIE | 2542 | QQYNTYST | KAPPA |
| 6.2M | COV072_6mo_P5_IGG_53-P1369 | 2543 | EVQLVQSGAEVKKPGESLTISCKGSGYSFTNYWIGWVRQLPGKGLEWMAIFYPGDSDTRFSPSFQGQVTMSADKSTSTAYLQWSSLKASDTAMYYCARPRHNSTWYYGAFDIWGQGTMVTVSS | 2544 | ARPRHNSTWYYGAFDI | COV072_6mo_P5_kappa_53-P1389 | 2545 | DIVMTQSPLSLSVTPGEPASISCRSSQSLFRSYGYNYLDWYLQKPGQSPQLLIYLGSNRASGVPDRFSGSGSGTDFTLKISRVEAEDVGVYYCMQSLQTPPNTFGPGTKVDIK | 2546 | MQSLTPPNT | KAPPA |
| 6.2M | COV072_6mo_P5_IGG_54-P1369 | 2547 | QVQLVESGGGVVQPGRSLRLSCAASGFTFNNYVMHWVRQAPDKGLEWVAGILYDGSDKNYADSVKGRFTISRDNSKNTLYLQMNSLRAEDTAVYYCAKQAGMYCSGGNCFLSYFDYWGQGALVTVSS | 2548 | AKQAGMYCSGGNCFLSYFDY | COV072_6mo_P5_kappa_54-P1389 | 2549 | DIQMTQSPSSLSASVGDRVTITCQASQDIKNNLNWYQQKPGKAPKLQIYDASNLETGVPSRFSGSGSGTDFTFTISSLQAEDTATYYCQQYENLPPTFGQGTRVEIK | 2550 | QQYENLPPT | KAPPA |
| 6.2M | COV072_6mo_P5_IGG_55-P1369 | 2551 | EVQLVESGGGLIQPGGSLRLSCAASGITVSRNYMSWVRQAPGKGLEWVSVIYPGGSTFHADSVKGRFTISRDNSKNMLYLQMNSLRAEDTAVYYCARVLYDAFDIWGQGTMVTVSS | 2552 | ARVLYDAFDI | COV072_6mo_P5_kappa_55-P1389 | 2553 | DIQLTQSPSFLSASVGDRVTITCRASQGISSYLAWYQQKPGKAPKLLIYSASTLQSGVPSRFSGSGSGTEFTLTISSLQPEDFATYYCQQLNSYPPCTFGPGTKVDIK | 2554 | QQLNSYPPCT | KAPPA |
| 6.2M | COV072_6mo_P5_IGG_56-P1369 | 2555 | EVQLVESGGGLVQPGGSLRLSCAASEITVSSNYMSWVRQAPGKGLEWVSLIYSGGSTYYADSVKRFTISRDNSKNTLYLQMNSLRADDTAVYYCARDPPSRRGSCWGQGTLVTVSS | 2556 | ARDPPSRRGSC | COV072_6mo_P5_kappa_56-P1389 | 2557 | DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK | 2558 | QQYDNLPIT | KAPPA |
| 6.2M | COV072_6mo_P5_IGG_5-P1369 | 2559 | EVQLVETGGGLIQPGGSLRLSCAASDLTVSSNYMNWVRQAPGKRLEWVSVIYPGGSTFYADSVKGRFTISRDNSKNTLYLQMNSLRAEDTAIYYCAREAYGMDVWGQGTTVTVSS | 2560 | AREAYGMDV | COV072_6mo_P5_kappa_5-P1389 | 2561 | EIVLTQSPGTLSLSPGERATLSCRASQSVASSYLAWYQQKPGQAPRLLIYGASSRAAGIPDRFSGSGSGTDFTLTISRLEPEDFAVYYCQQYGSSYTFGQGTKLEIK | 2562 | QQYGSSYT | KAPPA |
| 6.2M | COV072_6mo_ | 2563 | QVQLQESGPRLVKPAQTLSLTCTVSGVSISYGGYYWSWIRQHPGKGLEWIGNVYYSGSTYYNPS | 2564 | ARVNAHSHFDY | COV072_6mo_P5_ | 2565 | DIQMTQSPSSLSVSVGDRVTITCQASQDFGNSLHWYQQQPGKAPKLLIYDV | 2566 | QHSDNF | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | P5_IGG_61-P1369 | | LKSRLSISVDTSKNQFSLNLNSVTAADTAVYYCARVNAHSHFDYWGQGTLVTVSS | | | kappa_61-P1389 | | SNLETGVPSRFSGSGSGTDFALTINGLQPEDIATYYCQHSDNFFRYTFGQGTKLEIK | | FRYT | |
| 6.2M | COV072_6mo_P5_IGG_62-P1369 | 2567 | QVQLVQSGAEVKKPGSSVKVSCEASGDTFTRYSINWIRQTPGQGLEWMGRIIPLFPLANYAQKFQGRVTITADKSTSTAYMELSNLRSEDTAMYYCACSMSPVLGAPSNWFDPWGQGTLVTVSS | 2568 | ACSMSPVLGAPSNWFDP | COV072_6mo_P5_kappa_62-P1389 | 2569 | EIVLTQSPGTLSLSPGERATLSCRASQSVSSSYLAWYRQKPGQAPRLLIYGATSRATGIPDRFSGSGSGTDFTLTISRLEPEDFAVYYCQHYHSSPWAFGQGTKVEVK | 2570 | QHYHSSPWA | KAPPA |
| 6.2M | COV072_6mo_P5_IGG_63-P1369 | 2571 | QVQLVESGGGVVQPGRSLRLSCAASGFAFSTYGMHWVRQAPGKGLEWVAIISYDGSHTFYGDSVKGRFTISRDNSKKTLYLQMNSLRVEDTAVYYCAKQLGPYCSGGNCYVGYFDYWGQGTRVTVSS | 2572 | AKQLGPYCSGGNCYVGYFDY | COV072_6mo_P5_kappa_63-P1389 | 2573 | DIQMTQSPSSLSASVGDRVTITCQASQDITNYLIWYQQKPGKAPKLLIYDASNLEAGVPSRFSGRGSGTDFTFTISSLRPEDIATYYCQQYDNLPITFGQGTKLEIK | 2574 | QQYDNLPIT | KAPPA |
| 6.2M | COV072_6mo_P5_IGG_64-P1369 | 2575 | QVQLQESGPGLVKPSETLSLTCTVSGDSISGYYCSWIRQPPGKGLEWIGYIYSTGSTRYNPSLKSRVTISVDTSKNQFSLKLSSVTAADTAMYYCAREGHDFGSGYFEYWGQGTLVPVSS | 2576 | AREGHDFGSGYFEY | COV072_6mo_P5_kappa_64-P1389 | 2577 | EIVLTQSPGTLSLSPGERATLSCRASHSVSSFYVAWYQQKPGQAPRLLIYGASRRATGIPDRFSGSGSGTDFTLTISRLDPEDFAVYYCQQYGGSLVTFGQGTKLEIK | 2578 | QQYGGSLVT | KAPPA |
| 6.2M | COV072_6mo_P5_IGG_72-P1369 | 2579 | QVQLQESGPGLVKPSETLSLTCTASGGSISGSYWSWIRQPPGKSLEWIGNIDYSGGTDYNASLRSRLTMSVDTSKNQFNLKLTSVTAADTAVYFCARVVYYDSRGNYYQYYFDLWGRGTLVTVSS | 2580 | ARVVYYDSRGNYYQYYFDL | COV072_6mo_P5_kappa_72-P1389 | 2581 | EIVLTQSPGTLSLSPGERTTLSCRASLSVSSGYLAWYQHKPGQAPRLLIYGASSRATGIPDRFSGSGSGTDFTLTISRLEPEDFAVYYCQQYGGK | 2582 | QQYGGSPFT | KAPPA |
| 6.2M | COV072_6mo_P5_IGG_75-P1369 | 2583 | EVQLLESGGGLVQPGGSLRLSCEASGFSFSSYAMSWVRQAPGKGLEWVSGISGSGDAPNHADSVKGRFTISRDNSKNTLYLRMNSLRVEDTAVYFCAKLPTGRGGGVDYWGQGTLVTVSS | 2584 | AKLPTGRGGGVDY | COV072_6mo_P5_kappa_75-P1389 | 2585 | DIQMTQSPSSLSASVGDRVTITCRASLSINNYLNWYQQKPGRAPKLLIYAASSLQRGVPPRFSGSGSGTDFTLTISSLQPEDIAIYYCQQSYSWWTFGGGTKVEIK | 2586 | QQSYSWWT | KAPPA |
| 6.2M | COV072_6mo_P5_IGG_76-P1369 | 2587 | QVQLVESGGGVVQPGRSLRVSCAASGFTFSSYGMHWVRQAPGKGLEWVAFIWYDGTNKYYADSVKGRFTISRDNSKNTLYLQMNSLRAEDTAMYYCARVQGIDYGDYSWWGLDPWGQGTLVTVSS | 2588 | ARVQGIDYGDYSWWGLDP | COV072_6mo_P5_kappa_76-P1389 | 2589 | DIQLTQSPSFLSASVGDRVTITCRASQGISSYLAWYQQKPGKAPKLLISDASTLQSGVPSRFSGSGSGAEFTLTISSLQPEDFATYYCQQLNSYPFTFGQGTKLEIK | 2590 | QQLNSYPFT | KAPPA |
| 6.2M | COV072_6mo_P5_IGG_7-P1369 | 2591 | QVQLVQSGAEVKKPGSSVKVSCKASGDTFSSHAINWVROAPGOGLEWMGRSIPMLGVTTSAOKFKGRVTITADHSTSTVFMDLSSLRSDDTAIYYCARGVVGATPGSFDLWGQGTVVTVSS | 2592 | ARGVVGATPGSFDL | COV072_6mo_P5_kappa_7-P1389 | 2593 | EIVMTQSPATLSVSPGKRATLSCRASQSVRSNLAWYQQRPGQAPRLLIYDAATRATGIPTRFSGSGSGTEFTLTISSLQSEDFAVYYCQQYDNGLTFGGGTNVEIK | 2594 | QQYDNGLT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV072_6mo_P5_IGG_81-P1369 | 2595 | QVQLVESGGGVVQPGRSLRLSCAASGFTFSNYDMHWVRQAPGKGLEWVAVISSDGSSKFYGEPVKGRFTISRDNSKNTVYLQMNSLRAEDTAVYYCAKDPGESSWVDYFEYWGQGTLVTVSS | 2596 | AKDPGESSWVDYFEY | COV072_6mo_P5_kappa_81-P1389 | 2597 | DIQMTQSPSSLSASVGDRVTIACRASQNINNFLNWYQQKPGKAPKLLLYATSRLQSGVPSRFSGSGSGTHFTLTITSLQPEDFATYYCQQSYSNPGLTFGGGTKVDLK | 2598 | QQSYSNPGLT | KAPPA |
| 6.2M | COV072_6mo_P5_IGG_83-P1369 | 2599 | QVQLVQSGAEVKKPGASLKVSCKASGHTFSNYYIHWVRQAPGQGLEWMGIINPSGGSTSYAQKFQGRVTMTSDTSTSTVYMELSSLRTEDTAVYYCARGGLVPAANEVFDIWGQGTMVTVSS | 2600 | ARGGLVPAANEVFDI | COV072_6mo_P5_kappa_83-P1389 | 2601 | DIQMTQSPSTLSASVGDRVTITCRASQSISSWLAWYQQKPGNAPQLLIYKASTLESGVPSRFSGSGSGTEFTLTISSLQPDDFATYYCQHYNIYSPFTFGPGTKVDIK | 2602 | QHYNIYSPFT | KAPPA |
| 6.2M | COV072_6mo_P5_IGG_84-P1369 | 2603 | QVQLVESGGDIVQPGRSLRLSCATSGFSINDYGMHWVRQAPGKGLEWVAVIEYDGSNKYYADSVKGRFTISRDDSKNTLNLQMNSLRAEDTAVYYCARRGGLWFGEPPPYYYFYMDVWGKGTTVTVSS | 2604 | ARRGGLWFGEPPPYYYFYMDV | COV072_6mo_P5_kappa_84-P1389 | 2605 | DIVMTQSPLSLPVTPGESASISCRSSQSLLHSSGYNYVDWYMQKPGQSPQLLIYLGSNRASGVPDRFSGSGSGTDFTLKISRVEAEDVGVYYCMQTLQTPPFTFGQGTKLEIK | 2606 | MQTLQTPPFT | KAPPA |
| 6.2M | COV072_6mo_P5_IGG_86-P1369 | 2607 | EVQLLESGGGLVQPGGSLRLSCVASGFSFSTYAMSWVRQAPGQGLEWVSTITGTSIGTYYADSVKGRFTISRDNSKNTVFLQMKSLRAEDAAVYYCANHPLASGDEYYYYYMDVWGKGTTVTVSS | 2608 | ANHPLASGDEYYYYYMDV | COV072_6mo_P5_kappa_86-P1389 | 2609 | EIVLTQSPGTLSLSPGERATLSCRASQSVHSKQLAWYQQKPGQAPRLLIYGASSRATGIPDRFSGSGSGTDFTLTISRLEPEDFAVYYCQQYGSIRALTFGGGTKVEIK | 2610 | QQYGSIRALT | KAPPA |
| 1.3M | COV072_Plate2_HC_14-P1369 | 2611 | EVQLVESGGGLVQPGGSLRLSCAASGFTVSSNYMSWVRQAPGKGLEWVSVIYSGGSTYYADSVKGRFTISRDNSKNTLYLHMNSLRAEDTAVFYCASHLMPDAFDIWGQGTMVTVSS | 2612 | ASHLMPDAFDI | COV072_Plate2_Lambda_14-P1409 | 2613 | QSVLTQPASVSGSPGQSITISCTGTSSDVGSYNLVSWYQQHPGKAPKLMIYEVSKRPSGVSNRFSGSKSGNTASLTISGLQAEDEADYYCCSYGGSSTSFYVFGTGTKVTVL | 2514 | CSYGGSSTSFYV | LAMBDA |
| 1.3M | COV072_Plate2_HC_33-P1369 | 2615 | EVQLVESGGGLVQPGGSLRLSCAASGFTFSTYWMSWVRQPPGKGLEWVANIKQDGSEKYYVDSVKGRFTISRDNAKNSLYLQMNSLRADDTAVYYCAGGTWLRSSFDYWGQGTLVTVSS | 2616 | AGGTWLRSSFDY | COV072_Plate2_Lambda_33-P1409 | 1627 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVL | 2618 | QSYDSSNWV | LAMBDA |
| 1.3M | COV072_Plate2_HC_53-P1369 | 2619 | QVQLQESGPGLVKPSGTLSLTCAVSGGSISSNNWWSWVRQPPGKGLEWIGEIYHSGSTNYNPSLKSRVTISVDKSKNQFSLKLSSVTAADTAVYYCAKGGDRAMGPEYFDYWGQGTLVTVSS | 2620 | AKGGDRAMGPEYFDY | COV072_Plate2_Lambda_53-P1409 | 2621 | QSVLTQPASVSGSPGQSITISCTGTSSDVGGYNYVSWYQQHPGKAPKLMIYDVSNRPSGVSNRFSGSKSGNTASLTISGLQAEDEADYYCSSFTSSSTLLFGGGTRLTVL | 2622 | SSFTSSSTLL | LAMBDA |
| 1.3M | COV072_Plate2_HC_5-P1369 | 2623 | EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDTGRITFGGGDDAFDIWGQGTMVTVSS | 2624 | ARDTGRITFGGGDDAFDI | COV072_Plate2_Lambda_5-P1409 | 2625 | SYVLTQPPSVSVAPGKTARITCGGNNIGSKSVHWYQQKPGQAPVLVIYYDSDRPSGIPERFSGSKSGNTATLTISRVEAGDEADYYCQVWDSSSDHRVFGGGTKLTVL | 2626 | QVWDSSSDHRV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV072_Plate2_HC_71-P1369 | 2627 | QVQLQESGPGLVKPSQTLSLTCTVSGGSISSGGYYWNWIRQHPGKGLEWIGYIYYSGSTYYNPSLKSRVTISVDTSQNQFSLRLSSVTAADTAVYYCARGVVLITDYYFDYWGQGTLVTVSS | 2628 | ARGVVLITDYYFDY | COV072_Plate2_Lambda_71-P1409 | 2629 | SYVLTQPPSVSVSPGQTARITCSGDTLPKQYVYWYQQKPGQAPALVIYKDSERPSGIPERLSGSSSGTTATLTISGVQAEDEADYYCQSADSSGTRFGGGTKLTVL | 2630 | QSADSSGTR | LAMBDA |
| 1.3M | COV072_Plate2_HC_76-P1369 | 2631 | QVQLQESGPGLVKPSETLSLTCTVSGGSISSYYWSWIRQPPGKGLEWIGYIYYSGSTRYNPSLKSRVTISVDTSKNQFSLKLSSVTAADTAVFYCARGRGLPPWFDPWGQGTLVTVSS | 2632 | ARGRGLPPWFDP | COV072_Plate2_Lambda_76-P1409 | 2633 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNVVFGGGTKLTVL | 2634 | QSYDSSNVV | LAMBDA |
| 1.3M | COV072_Plate2_HC_81-P1369 | 2635 | QVQLVQSGAEVKKPGASVKVSCKASGYTFTSHYIHWVRQAPGQGLEWMGIINPSGGSTSYAQKFQGRVTMTRDTSTSTTLYMDLSSLRSEDTAVYYCAKSRPTPDWYFDLWGRGTLVTVSS | 2636 | AKSRPTPDWYFDL | COV072_Plate2_Lambda_81-P1409 | 2637 | SYVLTQPPSVSVAPGKTARITCGGNNIGSKSVHWYQQKPGQAPVLVIYYDNDRPSGIPERFSGSNSGNTATLTISRVEAGDEADYYCQVWDGGSDHPGVVFGGGTKLTVL | 2638 | QVWDGGSDHPGVV | LAMBDA |
| 1.3M | COV072_Plate2_HC_93-P1369 | 2639 | EVQLLESGGGLVQPGGSLRLSCAASGFTFSNYAMSWVRQAPGKGLEWVSAISGSDGSTYYAGSVKGRFTISRDNSKNTLYLQMNSLRAEDTAVYYCAKDPLITGPTYQYFHYWGQGTLVTVSS | 2640 | AKDPLITGPTYQYFHY | COV072_Plate2_Lambda_93-P1409 | 2641 | SYVLTQPPSVSVAPGKTARITCGGNNIGSKSVHWYQQKPGQAPVLVIYYDSDRPSGIPERFSGSNSGNTATLTISRVEAGDEAEYHCQVWDSSSDRPGVVFGGGTKLTVL | 2642 | QVWDSSSDRPGVV | LAMBDA |
| 1.3M | COV072_Plate2_HC_94-P1369 | 2643 | EVQLLESGGGLVQPGGSLRLSCAASGFTFSTYAMTWVRQAPGKGLEWVSAISGSGGRTYYADSVKGRFTISRDNSKNTLYLQMNSLRAEDTAVYYCAKVDYGEYVFSNAFDIWGQGTMVSVSS | 2644 | AKVDYGEYVFSNAFDI | COV072_Plate2_Lambda_94-P1409 | 2645 | QSVLTQPASVSGSPGQSITISCTGTSSDVGSYNLVSWYQQHPDKAPKLMIYEVSKRPSGVSNRFSGSKSGNTASLTISGLQAEDEADYYCCSYAGTSTYVFGTGTKLTVL | 2646 | CSYAGTSTYV | LAMBDA |
| 1.3M | COV072_P3_HC_12-P1369 | 2647 | EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARALQGPWLGADYWGQGTLVTVSS | 2648 | ARALQGPWLGKGV | COV072_Plate3_Lambda_12-P1409 | 2649 | NFMLNQPPCEXESPGKTVTISCTGSSGSIASNYDQWQQRPGSAPTTYVIYEDKQRTSGVLDWFSGSXARSSNSPSLTIXGRKREDEADXYCQSYDSSKGVFGGGTKLTVL | 2650 | QSYDSSKGV | LAMBDA |
| 1.3M | COV072_P3_HC_18-P1369 | 2651 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARPDMSSSSSPHYWYFDLWGRGTLVTVSS | 2652 | ARPDMSSSSSPHYWYFDL | COV072_Plate3_Lambda_18-P1409 | 2653 | SYVLTQPPSVSVAPGKTARITCGGNNIGSKNVHWYQQKPGQAPVLVVYYDSDRPSGIPERFSGSNSGNTATLTISRVEAGDEADYYCQVWDSSSGHFHVVFGGGTKLTVL | 2654 | QVWDSSSGHFHVV | LAMBDA |
| 1.3M | COV072_P3_HC_1-P1369 | 2655 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARVVGYDFWSGYDGGYFDYWGQGTLVTVSS | 2656 | ARVVGYDFWSGYDGGYFDY | COV072_Plate3_Lambda_1-P1409 | 2657 | QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTWVFGGGTKLTVL | 2658 | CSYAGSSTWV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV072_P3_HC_25-P1369 | 2659 | QVQLQESGPGLVKPSGTLSLTCAVSGGSISSNNWWSCVRQPPGKGLEWIGEIYHSGSTNYNPSLKSRVTISVDKSKNQFSLKLSSVTAADTAVYYCARGGDTAMGPEYFDYWGQGTLVTVSS | 2660 | ARGGDTAMGPEYFDY | COV072_Plate3_Lambda_25-P1409 | 2661 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLFGGGTKLTVL | 2662 | SSYTSSSTLL | LAMBDA |
| 1.3M | COV072_P3_HC_36-P1369 | 2663 | EVQLVESGGGLVKPGGSLRLSCAASGFSFRSYSMNWVRQAPGKGLEWVSSISSSSSYIYYADSVKGRFTISRDNAKNSLYLQMNSLRAEDTAVYYCARMGLELPGLDYGMDVWGQGTTVTVSS | 2664 | ARMGLELPGLDYGMDV | COV072_Plate3_Lambda_36-P1409 | 2665 | QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSFNGPVFGGGTKLTVL | 2666 | AAWDDSFNGPV | LAMBDA |
| 1.3M | COV072_P3_HC_38-P1369 | 2667 | EVQLVESGGGLVKPGGSLRLSCAASGFTFSTYSMNWVRQAPGKGLEWVSSISSSSNYIYYADSVKGRFTISRDNAKNSLYLQMNSLRAEDTAVYYCARAKLEIAHYGGSPGFDYWGQGTLVTVSS | 2668 | ARAKLEIAHYGGSPGFDY | COV072_Plate3_Lambda_38-P1409 | 2669 | SYELTQPPSVSVSPGQTASITCSGDKLGDKYTCWYQQKPGQSPVLVIYQDTQRPSGIPERFSGSNSGNTATLTISGTQAMDEADYYCQAWDSSTGVVFGGGTKVTVL | 2670 | QAWDSSTGVV | LAMBDA |
| 1.3M | COV072_P3_HC_40-P1369 | 2671 | QVQLVQSGAEVKKPGASVKVSCKASGYTFSSNYMHWVRQAPGQGLEWMGIINPSGGSTTYAQKFQGRVTMTRDTSTSTVYMELSSLRSEDTAVYYCARDLGYIPASDAFDIWGQGTMVTVS | 2672 | ARDLGYIPASDAFDI | COV072_Plate3_Lambda_40-P1409 | 2673 | QSVLTQPRSVSGSPGQSVTISCTGTSSDFGGYNYVSWYQQHPGKAPKLMIYDVSKRPSGVPDRFSGSKSGNTASLTISGLQAEDEADYYCCSYAGSYTRYVFGTGTKVTVL | 2674 | CSYAGSYTRYV | LAMBDA |
| 1.3M | COV072_P3_HC_44-P1369 | 2675 | QVQLVQSGAEVKKPGASVKVSCKASGYTFTSYGISWVRQAPGQGLEWMGWISAYNGNTKYAQKLQGRVTMTTDTSTSTAYMELRSLRSDDTAVYFCARVLGIIVAGSLNWGQGTLVTVSS | 2676 | ARVLGIIVAGSLN | COV072_Plate3_Lambda_44-P1409 | 2677 | NFVLTQPHSVSESPGKTVTISCTGSSGSIASNYVQWYQQRPGSAPTTVIYEDNQRPSGVPDRFSGSIDSSSNSASLTISGLKTEDEADYYCQSYDSSTWVFGGGTKLTVL | 2678 | QSYDSSTWV | LAMBDA |
| 1.3M | COV072_P3_HC_49-P1369 | 2679 | QVQLVQSGAEVKKPGASVKVSCKASGYTFTNYYMHWVRQAPGQGLEWMGIINPSGGSTGYAQKFQGRVTMTRDTSTSTVYMELSSLRSEDTAVYYCARSRPTPDWYFDLWGRGTLVTVSS | 2680 | ARSRPTPDWYFDL | COV072_Plate3_Lambda_49-P1409 | 2681 | SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPGVVFGGGTKLTVL | 2682 | QVWDSSS | LAMBDA |
| 1.3M | COV072_P3_HC_51-P1369 | 2683 | EVQLLESGGGLVQPGGSLRLSCAASGFTFSNYAMSWVRQAPGKGLEWVSAISGSDGSTYYAGSVKGRFTISRDNSKNTLYLQMNSLRAEDTAVYYCAKDPLITGPTYQYFHYWGQGTLVTVSS | 2684 | AKDPLITGPTYQYFHY | COV072_Plate3_Lambda_51-P1409 | 2685 | SYVLTQPPSVSVAPGKTARITCGGNNIGSKSVHWYQQKPGQAPVLVIYYDSDRPSGIPERFSGSNSGNTATLTISRVEAGDEAEYHCQVWDSSSDRPGVVFGGGTKLTVL | 2686 | QVWDSSSDRPGVV | LAMBDA |
| 1.3M | COV072_P3_HC_54-P1369 | 2687 | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNDGSSGWYPERGGGFDYWGQGTLVTVSS | 2688 | ARNDGSSGWYPERGGGFDY | COV072_Plate3_Lambda_54-P1409 | 2689 | QSVLTQPPSVSGAPGQRVTISCTGSSSNIGAGYDVKWYQQLPGTAPKLLIYGNSNRPSGVPDRFSGSKSGTSASLAITGLQAEDEADYYCQSYDSSLSGLWVFGGGTKLTVL | 2690 | QSYDSSLSGLWV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 1.3M | COV072_P3_HC_55-P1369 | 2691 | EVQLVESGGGLVKPGGSLRLSCAAASGFTISNAWMSWVRQAPGKGLEWVGRIKSKTDGGTTDYAAPVKGRFTISRDNSKNTLYLQMNSLKTEDTAVYYCTTDYSIRYYYGMDVWGQGTTVTVSS | 2692 | TTDYSIRYYYGMDV | COV072_Plate3_Lambda_55-P1409 | 2693 | SYVLTQPPSVAVSPGQTARITCSGDALPKQYAYWYQQKPGQAPVLVIYKDSERPSGIPERFSGSSSGTTVTLTISGVQAEDEADYYCQSADSSGTYEVFGGGTKVTVL | 2694 | QSADSSGTYEV | LAMBDA |
| 1.3M | COV072_P3_HC_56-P1369 | 2695 | QVQLVESGGGVVQPGRSLRLSCAASGFTFSNYGMHWVRQAPGKGLEWVAVLSYEGSSTYYADSVKGRFTISRDNSKNTLYLQMNSLRAEDTAVYYCAKAGGRDYYDSSGYYLLDHYYGMDVWGQGTTVTVSS | 2696 | AKAGGRDYYDSSGYYLLDHYYGMDV | COV072_Plate3_Lambda_56-P1409 | 2697 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGFYVFGTGTKVTVL | 2698 | QSYDSSLSGFYV | LAMBDA |
| 1.3M | COV072_P3_HC_71-P1369 | 2699 | QVQLVESGGGVVQPGRSLRLSCVASGFTFSSYGMHWVRQAPGKGLEWVAVIWYDGSNKYYADSVKGRFTISRDNSKNTLYLKMNSLRAEDTAVYYCARGEWDSGSYQYYDYYMDVWGKGTTVTVSS | 2700 | ARGEWDSGSYQYYDYYMDV | COV072_Plate3_Lambda_71-P1409 | 2701 | QSVLTQEPSFSVSPGGTVTLTCGLSSGSVSTSYYPSWYQQTPGQPPRTLIYITNTRSSGVPDRFSGSILGNKAALTITGAQADDESDYYCVLYMGSSNWVFGGGTKLTVL | 2702 | VLYMGSSNWV | LAMBDA |
| 1.3M | COV072_P3_HC_73-P1369 | 2703 | QVQLQQWGAGLLKPSETLSLTCAVYGGSFSAYSWSWIRQPPGKGLEWIGEINHGGSTNYNASLKSRVTISADTSKNLFSLKLSSVTAADTAVYYCAREGAVAGGDFDYWGQGTLVTVSS | 2704 | AREGAVAGGDFDY | COV072_Plate3_Lambda_73-P1409 | 2705 | SYVLTQPPSVSVAPGKTARITCGGNNIGSKSVHWYQQKPGQAPVLVIYYDSDRPSGIPERFSGSNSGNTATLTISRVEAGDEADYYCQVWDGTSDHPGWVFGGGTKLTVL | 2706 | QVWDGTSDHPGWV | LAMBDA |
| 1.3M | COV072_P3_HC_77-P1369 | 2707 | QVQLVQSGAEVKKPGSSVKVSCKASGGTFSSYTISWVRQAPGHGLEWMGRIIPILGIANYAQKFQGRVTITADKSTSTAYMELSSLRSEDTAVYYCARFSNYCTSTSCYDYWGQGTLVTVSS | 2708 | ARFSNYCTSTSCYDY | COV072_Plate3_Lambda_77-P1409 | 2709 | QSVLTQPPSVSGAPGQRVTISCTGSNSNIGAGYDVHWYQQLPGTAPKLLIYVNSNRPSGVPDRFSGSKSGTSASLAITGLQAEDEADYSCQSYDSSLSGSVFGTGTKVTVL | 2710 | QSYDSSLSGSV | LAMBDA |
| 1.3M | COV072_P3_HC_84-P1369 | 2711 | EVQLVQSGAEVKKPGESLKISCKGSGYSFTSYWIVWVRQMPGKGLERMGIIYPGDSDTRYSPSFQGQVTISADKSISTAYLQWSSLKASDTAMYYCARRGGSYYNNGDGMDVWGQGTTVTVSS | 2712 | ARRGGSYYNNGDGMDV | COV072_Plate3_Lambda_84-P1409 | 2713 | SYVLTQPPSVSVSPGQTASITCFGDKLGDKYACWYQQKPGQSPVLVIYQDSKRPSGIPERFSGSNSGNTATLTISGTQAMDEADYYCQAWDSSTPHVVFGGGTKLTVL | 2714 | QSWDSSTPHVV | LAMBDA |
| 1.3M | COV072_P3_HC_91-P1369 | 2715 | QVQLVESGGGVVQPGRSLRLSCAASGFTFSSYAMFWVRQAPGKGLEWVAVISYDGSNKYYADSVKGRFTISRDNSKNTLYLQMNSLRAEDTAVYYCARADLGYCTNGVCYVDYWGQGTLVTVSS | 2716 | ARADLGYCTNGVCYVDY | COV072_Plate3_Lambda_91-P1409 | 2717 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVL | 2718 | QSYDSSNWV | LAMBDA |
| 1.3M | COV072_P3_HC_94-P1369 | 2719 | QVQLVESGGGVVQPGRSLRLSCAASGFTFSSYAIHWVRQAPGKGLEWVAVISNDGSNKYYEDSVKGRFTFSRDNSKNTLYLQMNSLRAEDTAVYYCARALSFIAVAGIDYWGRGTLVTVSS | 2720 | ARALSFIAVAGIDY | COV072_Plate3_Lambda_94-P1409 | 2721 | NFMLTQPHSVSESPGKTVTISCTGSSGSIASNYVQWYQQRPGSAPTIVIYEDNQRPSGVPDRFSGSIDSSSNSASLTISGLKTEDEADYYCQSYDSTTHVVFGGGTKLIVL | 2722 | QSYDSTTHVV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV072_Plate2_HC_12-P1369 | 2723 | QVQLVESGGGVVQPGRSLRLSCAASGFTFSHYAMHWVRQAPGKGLEWVAVIPFDGSNKYYADSVKGRFTISRDNSKNTLYLQMNSLRAEDTAVYYCASSSGYLFHFDYWGQGTLVTVSS | 2724 | ASSSGYLFHFDY | COV072_Plate2_Kappa_12-P1389 | 2725 | DIQMTQSPSTLSASVGDRVTITCRASQSISSWLAWYQQKPGKAPKLLIYKASSLESGVPSRFSGSGSGTEFTLTISSLQPDDFATYYCQQYNSYPWTFGQGTKVEIK | 2726 | QQYNSYPWT | |
| 1.3M | COV072_Plate2_HC_15-P1369 | 2727 | QVQLVESGGGVVQPGRSLRLSCAASGFTFSSYAMHWVRQAPGKGLEWVAVISYDGTDSVKGRFTISRDTSKNMLYLQMNSLRAEDTAVYYCAKGPRFGWSYRGGPGFDIWGQGTMVTVSS | 2728 | AKGPRFGWSYRGGPGFDI | COV072_Plate2_Kappa_15-P1389 | 2729 | DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK | 2730 | QQYDNLPIT | KAPPA |
| 1.3M | COV072_Plate2_HC_16-P1369 | 2731 | EVQLVESGGDLVQPGGSLRLSCAASGLTVSSNYMSWVRQAPGKGLEWVSVIYSGGSTFYADSVKGRFTISRDNSQNTLYLQMNSLRAEDTAVYYCARDLQYYGMDVWGQGTTVTVSS | 2732 | ARDLQYYGMDV | COV072_Plate2_Kappa_16-P1389 | 2733 | DIQLTQSPSFLSASVGDRVTITCRASQGISSYLAWYQQKPGKAPKLLIYAASTLQSGVPSRFSGSGSGTEFTLTISSLQPEDFATYYCQQPDSFTFGPGTKVDIK | 2734 | QQPDSFT | KAPPA |
| 1.3M | COV072_Plate2_HC_23-P1369 | 2735 | QVQLVESGGGVVQPGRSLRLSCAASGFTFSNYAMHWVRQAPGKGLEWVAVISYDGSKKYSADSVKGRFTISRDNSKNTLYLQMNSLRPVDTAVYYCARVRLGAYYNYFGMDVWGQGTTVTVSS | 2736 | ARVRLGAYYNYFGMDV | COV072_Plate2_Kappa_23-P1389 | 2737 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTFTFGPGTKVDIK | 2738 | MQALQTFT | KAPPA |
| 1.3M | COV072_Plate2_HC_24-P1369 | 2739 | EVQLLESGGGLVQPGGSLRLSCAASGFTFSTYAMSWVRQAPGKGLEWVSTITGSGRDTYYADSVKGTLRFTISRDNSKNFLQLNSLRAEDAAVYSCANHPLASGDDYYHYYMDVWGKGTTVTVSS | 2740 | ANHPLASGDDYYHYYMDV | COV072_Plate2_Kappa_24-P1389 | 2741 | EIVLTQSPGTLSLSPGERATLSCRASQSVNSRQLAWYQQKPGQAPRLLIYGASSRATGIPERFSGSGSGTDFTLTISRLESEDFAVYHCQQYGSSRALTFGGGTKVEIK | 2742 | QYGSSRALT | KAPPA |
| 1.3M | COV072_Plate2_HC_25-P1369 | 2743 | QVQLVESGGGVVQPGRSLRLSCAASGFTFSTYGMHWVRQAPGKGLEWVAVIWYDGNNKYYADSVKGRFTISRDNSKNTLYLQMNSLRAEDTAVYYCATSLFGIISLDYWGQGTLVTVSS | 2744 | ATSLFGIISLDY | COV072_Plate2_Kappa_25-P1389 | 2745 | AIQMTQSPSSLSASVGDRVTITCRAGQGIRNDLGWYQQKPGKAPKLLIYAASSLQSGVPSRFSGSGSGTDFTLTISSLQPEDFATYYCLQDYNYPYTFGQGTKLEIK | 2746 | LQDYNYPYT | KAPPA |
| 1.3M | COV072_Plate2_HC_31-P1369 | 2747 | QVQLVESGGGVVQPGRSLRLSCAASGFTFSSYGMNWVRQAPGKGLEWVAVISYDGSNTYYTDSVKGRFTISRDNSKNTLYLQMNSLRVDDTATYYCAKGPRFGWSYRGGSGFDIWGQGTMVTVSS | 2748 | AKGPRFGWSYRGGSGFDI | COV072_Plate2_Kappa_31-P1389 | 2749 | DIQMTQSPSSLSASVGDRVTITCQASQDISNYLNWYQQKPGKAPKLLIYDASNLETGVPSRFSGSESGTDFTFTISSLQPEDIATYYCQQYDNLPITFGQGTRLEIK | 2750 | QQYDNLPIT | KAPPA |
| 1.3M | COV072_Plate2_HC_32-P1369 | 2751 | QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARTYYYDSSGYYFQYYFDCWGQGTLVTVSS | 2752 | ARTYYYDSSGYYFQYYFDC | COV072_Plate2_Kappa_32-P1389 | 2753 | EIVLTQSPGTLSLSPGERATLSCRASLSVSSSYLAWYQQKPGQAPRLLIYGASSRATGIPDRFSGSGSGTDFTLTISRLEPEDFAVYYCQQYGSSPLTFGGGTKVEIK | 2754 | QQYGSSPLT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV072_Plate2_HC_36-P1369 | 2756 | EVQLVESGGGLVQPGGSLRLSCAASGVTVSSNYMSWVRQAPGKGLEWVSLIYSGGSTFYADSVKGRFTISRDNSENTLYLQMNTLRAEDTAVYYCARDLYYYGMDVWGQGTTVTVSS | 2757 | ARDLYYYGMDV | COV072_Plate2_Kappa_36-P1389 | 2758 | DIQLTQSPSFLSASVGDRVTITCRASQGISSYLAWYQQKPGKAPKLLIYAASTLQSGVPSRFSGSGSGTEFTLTISSLQPEDFATYYCQQLNSYSYTFGQGTKLEIK | 2759 | QQLNSYSYT | KAPPA |
| 1.3M | COV072_Plate2_HC_37-P1369 | 2759 | EVQLVESGGGLVQPGGSLRLSCAASGFTFSSYWMSWVRQAPGKGLEWVANIKQDGSVKYYVDSVKGRFTISRDNAKNSLYLQMNSLRDEDTAVYYCARDQVSWYNLDAFDIWGQGTMVTVSS | 2760 | ARDQVSWYNLDAFDI | COV072_Plate2_Kappa_37-P1389 | 2761 | DVVMTQSPLSLPVTLGQPASISCRSSQSLVYSDGDTYLNWFQQRPGQSPRRLIYKVSNRDSGVPDRFSGSGSGTDFTLKSRVEAEDVGVYYCMQGTHWPKTFGQGTKLEIK | 2762 | MQGTHWPKT | KAPPA |
| 1.3M | COV072_Plate2_HC_40-P1369 | 2763 | QVQLVQSGAEVKKPGSSVKVSCKASGGTFSSYAINWVRQAPGQGLEWMGRIIPILDISNYAQKFQGRVTITADKSTSIAYMELSSLRSEDTAVYYCARGGYSYGQLYYFDYWGQGTLVTVSS | 2764 | ARGGYSYGQLYYFDY | COV072_Plate2_Kappa_40-P1389 | 2765 | EIVLTQSPGTLSLPPGERATLSCRASQSVSSSYLAWYQQKPGQAPRLLIYGASSRATGIPDRFSGSGSGTDFTLTISRLEPEDFAVYYCQQYANSRTFGQGTKVEIK | 2766 | QQYANSRT | KAPPA |
| 1.3M | COV072_Plate2_HC_54-P1369 | 2767 | QVQLVESGGGVVQPGRSLRLSCAASGFTFNNYGMHWVRQAPGKGLEWVAVIWYDGSNKYYADSVKGRFTISRDNSKNTVYLQMNSLRAEDTAVYYCARDWEIVVAGMDVWGQGTTVTVSS | 2768 | ARDWEIVVAGMDV | COV072_Plate2_Kappa_54-P1389 | 2769 | DVVMTQSPLSLPVTLGQPASISCRSSQSLVYNDGNTYLNWFQQRPGQSPRRLIYKVSNRDSGVPDRFSGSGSGTDFTLKISRVEAEDVGVYYCMQGTHCPFTFGPGTKVDIK | 2770 | MQGTHCPFT | KAPPA |
| 1.3M | COV072_Plate2_HC_63-P1369 | 2771 | QVQLVESGGGVVQPGRSLRLSCAASGFTFSSYAMHWVRQAPGKGLEWVAVISYDGSNKYSADSVKGRFTISRDNSKNTLYLQMNSLRAEDTAVYYCAKGGAYSYYYYMDVWGKGTTVTVSS | 2772 | AKGGAYSYYYYMDV | COV072_Plate2_Kappa_63-P1389 | 2773 | DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTK | 2774 | QQYDNLPLT | KAPPA |
| 1.3M | COV072_Plate2_HC_66-P1369 | 2775 | EVQLLESGGGLVQPGGSLRLSCVASRFTFSNYAMSWVRQAPGKGLEWVSTITGTGDHTYYADSVKGRFTISRDNSKNTLYLQMNSLRAEDTAIFYCANSPCSSASCKSGYYYYYMDVWGKGTTVTVSS | 2776 | ANSPCSSASCKSGYYYYYMDV | COV072_Plate2_Kappa_66-P1389 | 2777 | EIVLTQSPGTLSLSPGERATLFCRASQSVTSSHLAWYQQKAGQAPRLLIYGASSRATGIPDRFSGSGSGTDFTLTISRLEPEDFAVYYCQQYGSSRSLTFGGGTKVEIK | 2778 | QQYGSSRSLT | KAPPA |
| 1.3M | COV072_Plate2_HC_67-P1369 | 2779 | QVQLQESGPGLVKPSQTLSLTCTVSGGSISSGGYYWSWIRQHPGKGLEWIGYIYYSGSTYYNPSLKSRVTISVDTSKKQFSLKLSSVTAADTAVYYCATNYDDYVPAEYFQDWGQGTLVTVSS | 2780 | ATNYDDYVPAEYFQD | COV072_Plate2_Kappa_67-P1389 | 2781 | EIVLTQSPATLSLSPGERATLSCRASQSVSSYLAWYQQKPGQAPRLLIYDASNRATGIPARFSGSGSGTDFTLTISSLEPEDFAVYYCQQRSNWPPLTFGGGTKVEIK | 2782 | QQRSNWPPLT | KAPPA |
| 1.3M | COV072_Plate2_HC_72-P1369 | 2783 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDGTGIAAAGTANPPFDYWGQGTLVTVSS | 2784 | ARDGTGIAAAGTANPPFDY | COV072_Plate2_Kappa_72-P1389 | 2785 | DIQMTQSPSSLSASVGDRVTITCQASQDISNYLNWYQQKPGKAPKLLIYDASNLETGVPSRFSGSGSGTDFTFTISSLQPEDIATYYCQQYDNLPYTFGQGTKLEIK | 2786 | QQYDNLPYT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV072_Plate2_HC_74-P1369 | 2787 | QLQLQESGPGLVKPSETLSLTCTVSGGSISSSYYWGWIRQSPGKGLEWIGSIYYSGSTYYNPSLKSRVTISVDTSKNQFSLKLSSVTAADTAVYYCARRPPGDYYYMDVWGKGTTVTVSS | 2788 | ARRPPGDYYYMDV | COV072_Plate2_Kappa_74-P1389 | 2789 | DIQMTQSPSSLSASVGDRVTITCRASQSISSYLNWYQQKPGKAPKLLIYAASSLQSGVPSRFSGSGSGTDFTLTISSLQPEDFATYYCQQSYSIPQITFGQGTRLEIK | 2790 | QQSYSIPQIT | KAPPA |
| 1.3M | COV072_Plate2_HC_78-P1369 | 2791 | EVQLVESGGVVVQPGGSLRLSCAASGFTFDDHTMHWVRQAPGKGLEWVSLISWDAGSTYYADSVKGRFTISRDNRKNFLYLQMNSLRTEDTALYYCAKGLNYRPQYYYYYGMDVWGQGTTVTVSS | 2792 | AKGLNYRPQYYYYYGMDV | COV072_Plate2_Kappa_78-P1389 | 2793 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIK | 2794 | MQALQTPWT | KAPPA |
| 1.3M | COV072_Plate2_HC_83-P1369 | 2795 | QVQLVESGGGVVQPGRSLRLSCAASGFTFSTYAMHWVRQAPGKGLEWVAVISYDGTNKFYADSVKGRFTISRDNSKNTLYLQMNSLRAEDTAVFYCARDSDVDTAMVTWFDYWGQGTLVTVSS | 2796 | ARDSDVDTAMVTWFDY | COV072_Plate2_Kappa_83-P1389 | 2797 | DIQMTQSPSSLSASVGDRVTITCRASQSISSYLNWYQHKPGKAPKLLIYASSSLQSGVPSRFSGSGSGTDFTLTISSLQPEDFATYYCQQSYSTPPWTFGQGTKVEIK | 2798 | QQSYSTPPWT | KAPPA |
| 1.3M | COV072_Plate2_HC_86-P1369 | 2799 | QVQLQESGPGLVKPSQTLSLTCTVSGGSISSGDYSWSWIRQPPGKGLEWIGYIYYSGSTYYNPSLKSRVTISVDTSKNQFSLKLSSVTAADTAVYYCVRVVMSGIAAAGQNDYWGQGTLVTVSS | 2800 | VRVVMSGIAAAGQNDY | COV072_Plate2_Kappa_86-P1389 | 2801 | DIQMTQSPSSLSASVGDRVTITCQASQDISSYLNWYQQKPGKAPKLLIYDASNLETGVPSRFSGSGSGTDFTFTISSLQPEDIATYYCQQYDILPPMYTFGQGTKLEIK | 2802 | QQYDILPPMYT | KAPPA |
| 1.3M | COV072_Plate2_HC_88-P1369 | 2803 | QVQLQESGPGLVKPSQTLSLTCTFSGGSISSGGHYWSWIRQHPGKGLEWIGYIYYSGSTYYNPSLKSRVIISVDTSKNQFSLRLSSVTAADTAVYYCARSCSSTSCPFDYWGQGTLVTVSS | 2804 | ARSCSSTSCPFDY | COV072_Plate2_Kappa_88-P1389 | 2805 | DIQMTQSPSSLSASVGDRVTITCQASQDISNSLNWYQQKPGKAPKVLIYDASNLETGVPSRFSGSGSGTDFTFTISSLQPEDFATYYCQQYDNLPFTFGPGTKVDIK | 2806 | QQYDNLPFT | KAPPA |
| 1.3M | COV072_Plate2_HC_89-P1369 | 2807 | EVQLVETGGGLIQPGGSLRLSCAASGITVSSNYMSWVRQAPGKGLEWVSIIYSGGSTFYADSVKGRFTISRDNPKNTLYLQMNSLRAEDTAVYYCARDLYYYGMDVWGQGTTVTVS | 2808 | ARDLYYYGMDV | COV072_Plate2_Kappa_89-P1389 | 2809 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPTFGQGTKLEIK | 2810 | QQLNSYPT | KAPPA |
| 1.3M | COV072_Plate2_HC_92-P1369 | 2811 | EVQLLESGGGLVQPGGSLRLSCAASGFTFSSYAMSWVRQAPGKGLEWISAISGSGGRTYNADSVKGRFTISRDNSKNTLYLQMNSLRAEDTAVYYCAKAGPAAAYGWYYYYMDVWGKGTTVTASS | 2812 | AKAGPAAAYGWYYYYMDV | COV072_Plate2_Kappa_92-P1389 | 2813 | DIQMTQSPSSLSASVGDRVTITCRASQGISNYLAWYQQKPGKVPKLLIYAASTLQSGVPSRFSGSGSGTDFTLTISSLQPEDVSTYYCQKYNSALGFTFGPGTKVDIK | 2814 | QKYNSALGFT | KAPPA |
| 1.3M | COV072_Plate2_HC_9-P1369 | 2815 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDGITGTIEYYFDYWGQGTLVTVSS | 2816 | ARDGITGTIEYYFDY | COV072_Plate2_Kappa_9-P1389 | 2817 | EIVLTQSPATLSLSPGERATLSCRASQSVSSYLAWYQQKPGQAPRLLIYDASNRATGIPARFSGSGSGTDFTLTISSLEPEDFAVYYCQQRSNWPPGVTFGQGTRLEIK | 2818 | QQRSNWPPGVT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 1.3M | COV072_P3_HC_10-P1369 | 2819 | QVQLVQSGAEVKKPGASVKVSCKASGYTFTSYYIHWVRQAPGQGLEWMGIINPSAGSTSYAQKFQGRVTMTRDTSTSTVYMELSSLRSEDTAVYYCADIALVPMGLDYWGQGTLVTVSS | 2820 | ARDIALVPAAMGLDY | COV072_Plate3_Kappa_10-P1389 | 2821 | DIQMTQSPSSLSASVGDRVTITCRASQSSSRYLNWYQQKPGKAPKLLIYAASSLQSGVPSRFSGSGSGTDFTLTISSLQPEDFATYYCQQSYRTRLTFGGGTKVEI | 2822 | QQSYRTRLT | KAPPA |
| 1.3M | COV072_P3_HC_17-P1369 | 2823 | QVQLVQSGSEVKKPGSSVKVSCKASGGTFSSYAFSWVRQAPGQGLEWMGRIIPILALANYAQKFQGRVTITADKSTSTAYMELSSLRSEDTAVYYCARVNQAVTTPFSMDVWGQGTTVTVSS | 2824 | ARVNQAVTTPFSMDV | COV072_Plate3_Kappa_17-P1389 | 2825 | EIVMTQSPATLSVSPGERATLSCRASQSVSSNLAWYQQKPGQAPRLLIYGASTRATGIPARFSGSGSGTEFTLTISSLQSEDFAVYYCQQYNNWPITFGQGTRLEIK | 2826 | QQYNNWPIT | KAPPA |
| 1.3M | COV072_P3_HC_21-P1369 | 2827 | QVQLVQSGAEVKKPGSSVKVSCKASGDTFSSSALSWVRQAPGQGLEWMGRIIPILGITNYAQKFQGRVTITADKSTSTAYMELNSLRSEDTAVYYCARANQPVTTPFSMDVWGQGTTVTVSS | 2828 | ARANQPVTTPFSMDV | COV072_Plate3_Kappa_21-P1389 | 2829 | EIVMTQSPATLSVSPGERATLSCRASQSVSSNLAWYQQKPGQAPRLLIYAASTRATGIPARFSGSGSGTEFTLTISSLQSEDFAVYYCQQYNNWPITFGQGTRLEIK | 2830 | QQYNNWPIT | KAPPA |
| 1.3M | COV072_P3_HC_22-P1369 | 2831 | EVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKDITMIVDVFEYWGQGTLVTVSS | 2832 | VKDITMIVDVFEY | COV072_Plate3_Kappa_22-P1389 | 2833 | DIQMTQSPSSLSASVGDRVTITCRASQSISNYLNWYQQKPGKAPKLLIYAASSLQSAVPSRFSGSGSGTDFTLTISSLQPEDFATYFCQQSYTTPYTFGQGTKLEIK | 2834 | QQSYTTPYT | KAPPA |
| 1.3M | COV072_P3_HC_26-P1369 | 2835 | EVQLVESGGGLIQPGGSLRLSCAASGFTVSSNYMSWVRQAPGKGLEWISVIYSGGSTFYADSVKGRFTISRDNSKDTLYLQMNRLRAEDTAVYYCARSFYFDAFDIWGQGTMVTVSS | 2836 | ARSFYFDAFDI | COV072_Plate3_Kappa_26-P1389 | 2837 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPLLTFGGGTKVEIK | 2839 | QQLNSYPLLT | KAPPA |
| 1.3M | COV072_P3_HC_30-P1369 | 2839 | QVQLVQSGAEVKKPGSSVKVSCKASGGTFSSYAISWVRQAPGQGLEWMGRIIPMLVIATYARKFQGRVTITADKSTSTAYMELSSLRSEDTAVYYCARGVVAATPGNFDIWGQGTMVTVSS | 2840 | ARGVVAATPGNFDI | COV072_Plate3_Kappa_30-P1389 | 2841 | EIVMTQSPATLSVSPGERATLSCRASQSVSSNLAWYQQKPGQAPRLLIYGASTRATGIPARFSGSGSGTEFTLTISSLQSEDFAVYYCQQYNNGLTFGGGTKVEIK | 2842 | QQYNNGLT | KAPPA |
| 1.3M | COV072_P3_HC_31-P1369 | 2843 | QVQLVQSGAEVKKPGSSVKVSCKASGGTVNNYAINWVRQAPGQGLEWMGGIVPIFGTPNYAQKFQGRVTITADESTSTAYMELSSLRSEDTAVYYCAKVSLTLPIAAAPRFWFDSWGQGTLVTVSS | 2844 | AKVSLTLPIAAAPRFWFDS | COV072_Plate3_Kappa_31-P1389 | 2845 | EIVMTQSPATLSVSPGERATLSCRASQSVSSHLAWYQQKPGQAPRLLIYGASTRATGIPARFSGSGSGTEFTLTISSLQSEDFAVYYCQQYHNWPPALTFGGGTKVEIK | 2846 | QQYHNWPPALT | KAPPA |
| 1.3M | COV072_P3_HC_34-P1369 | 2847 | QVQLVQSGAEVKKPGASVKVSCKVSGYTLTELSMHWVRQAPGKGLEWMGGFDPEDGETIYVQKFQGRATMTEHTSTETAYMELSSLRSEDTAVYYCATNAEIAARKGGMDVWGQGTTVTVSS | 2848 | ATNAEIAARKGGMDV | COV072_Plate3_Kappa_34-P1389 | 2849 | DIVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPWTFGQGTKVEIK | 2850 | MQALQTPWT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 1.3M | COV072_P3_HC_37-P1369 | 2851 | QVQLVESGGGVVQPGRSLRLSCAASGFTFSSYGMHWVRQAPGKGLEWVAVISYDGSNKYYADSVKGRFTISRDNSKNMLYLQMNSLRAEDTAVYYCAKQNGLYCSGGSCYLGYFDYWGQGTLVTVSS | 2852 | AKQNGLYCSGGSCYLGYFDY | COV072_Plate3_Kappa_37-P1389 | 2853 | DIQMTQSPSSLSASVGDRVTITCQASQDISNYLNWFQQKPGKAPKLLIYAASDLETGVPSRFSGSGSGTDFTFTISSLQPEDIASYYCLQYDNLPLTFGGGTKVEIK | 2854 | LQYDNLPLT | KAPPA |
| 1.3M | COV072_P3_HC_3-P1369 | 2855 | QVQLVESGGGVVQPGRSLRLSCAVSGFTFSSYGMHWVRQAPGKGLEWVAVISYDGSNKHYADSVKGRFTISRDNSKNTLYVQMNSLRAEDTAMYYCAKQLGLYCSGGNCYSGALDYWGQGTLVTVSS | 2856 | AKQLGLYCSGGNCYSGALDY | COV072_Plate3_Kappa_3-P1389 | 2857 | DIQMTQSPSSLSASVGDRVTITCQASQDISNYLNWYQQKPGKAPKLLIYDASNLETGVPSRFSGSGSGTDFTFTISSLQPEDIATYYCQQYDNLPFTFGPGTKVDIK | 2858 | QQYDNLPFT | KAPPA |
| 1.3M | COV072_P3_HC_42-P1369 | 2859 | QMQLVQSGPEVKKPGTSVKVSCKASGFTFTNSAVQWVRQSRRQRLEWIGWIVVGSGNTNYAQKFQERVTITRDMSTSTAYMELSSLRSEDTAVYYCAAVDCNSTSCYDAFDIWGQGTMVTVSS | 2860 | AAVDCNSTSCYDAFDI | COV072_Plate3_Kappa_42-P1389 | 2861 | EIVLTQSPGTLSLSPGERATLSCRASQSFRSSYLAWYQQKPGQAPRLLIYGASSRATGIPDRFSGSGSGSDFTLTISRLEPEDFAVYYCQQYDISPWTFGQGTKVEIK | 2862 | QQYDISPWT | KAPPA |
| 1.3M | COV072_P3_HC_45-P1369 | 2863 | QVQLVESGGGVVQPGRSLRLSCAASGFTFSSYAMHWVRQAPGKGLEWVAVIPFDGRNKYYADSVTGRFTISRDNSKNTLYLQMNSLRAEDTAVYYCASSSGYLFHSDYWGQGTLVTVSS | 2864 | ASSSGYLFHSDY | COV072_Plate3_Kappa_45-P1389 | 2865 | DIQMTQSPSTLSASVGDRVTITCRASQSISNWLAWFQQKPGKAPKLLIYEAXSLESGVPSRFSGSGSGTEFTLTISSLQPDDFATYYCQQYNSYPWTFGQGTKVEIK | 2866 | QQYNSYPWT | KAPPA |
| 1.3M | COV072_P3_HC_47-P1369 | 2867 | EVQLVESGGGLVQPGGSLRLSCAASEFIVSRNYMSWVRQAPGKGLEWVSLIYSGGSTYYADSVKGRFTISRDNSKNTLYLQMNSLRAEDTAMYYCARDIAGRLDYWGQGTLVTVSS | 2869 | ARDIAGRLDY | COV072_Plate3_Kappa_47-P1389 | 2870 | DIQMTQSPSSLSASVGDRVTITCQASQDISKYLNWYQQKPGKAPKLLIYDASNLETGVPSRFSGSGSGTDFTFTISSLQPEDFATYYCQHYDSLSRLTFGGGTKVEIK | 2871 | QYDSLSRLT | KAPPA |
| 1.3M | COV072_P3_HC_48-P1369 | 2871 | QVQLVQSGAEVKKPGSSVKVSCKASGGTFSSYAINWVRQAPGQGLEWMGRIIPIVGIANYAQKFQGRVTITADKSSSTAYMELSSLRSEDTAVYYCARDLLDPQLDDAFDIWGQGTMVTVSS | 2872 | ARDLLDPQLDDAFDI | COV072_Plate3_Kappa_48-P1389 | 2873 | EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPWTFGQGTKVEIK | 2874 | QQYGSSPWT | KAPPA |
| 1.3M | COV072_P3_HC_4-P1369 | 2875 | QVQLQQSGPGLVKPSQTLSLTCAISGDSVSSNSTAWNWIRQSPSRGLEWLGRTYYRSKWYNHYALSVKSRITINPDTSKNQFSLQLNSVTPEDTAVYYCARSGSYYISHGMDVWGQGTTVTVSS | 2876 | ARSGSYYISHGMDV | COV072_Plate3_Kappa_4-P1389 | 2878 | EIVMTQSPATLSVSPGERATLSCRASQSVSSNLAWYQQRPGQAPRLLIYGASTRATGIPARFSGSGSGTEFTLTISSLQSEDFAVYYCQQYNNWPPWTFGQGTKVEIK | 2879 | QQYNNWPPWT | KAPPA |
| 1.3M | COV072_P3_HC_50-P1369 | 2879 | EVQLLESGGGLVQPGGSLRLSCAASGFTFSTYAMSWVRQAPGKGLEWVSTITGSGGFTYYADSVKGRFTISRDNSKNTLFLQMNSLRAEDAAVYYCANHPLASGDEYYYYYMDVWGKGTTVTVSS | 2880 | ANHPLASGDEYYYYYMDV | COV072_Plate3_Kappa_50-P1389 | 2881 | EIVLTQSPGTLSLSPGERATLSCRASQSVNSRQLAWYQQKPGQGPRLLIYGASSRATGIPDRFSGSGSGTDFTLTISRLEPEDFAVYYCQQYGSSRALTFGGGTKVEIK | 2882 | QQYGSSRALT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV072_P3_HC_53-P1369 | 2883 | QVQLVESGGGVVQPGRSLRLSCAASGFTFSSYAMHWVRQAPGKGLEWVAVILYDGSNKYYADSVKGRFTISRDNSKNTLYLQMNSLRAEDTAVYYCARDSDVDTSMVTWFDYWGQGTLVTVSS | 2884 | ARDSDVDTSMVTWFDY | COV072_Plate3_Kappa_53-P1389 | 2885 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK | 2886 | QQSYSTPPWT | KAPPA |
| 1.3M | COV072_P3_HC_58-P1369 | 2887 | QVQLVESGGGLVKPGGSLRLSCAASGFTFSHYNMIWIRQAPGKGLEWVSYISSSSSYTNCSDSVRGRFTISRDNAKNSLYLQMNSLRAEDTAVYYCARDRGYSGYGLDRFDYWGQGTLVTVSS | 2888 | ARDRGYSGYGLDRFDY | COV072_Plate3_Kappa_58-P1389 | 2889 | DIQMTQSPSSLSASVGDRVTITCQASQDISNYLNWYQQKPGKAPKLLIYDASHLETGVPSRFSGSGSGTDFTFTISSLQPEDIATYYCQQYDNLPLTFGGGTKVEIK | 2890 | QQYDNLPLT | KAPPA |
| 1.3M | COV072_P3_HC_59-P1369 | 2891 | EVQLVESGGGLVQPGGSLRLSCAASGFIVSSNYMSWVRQAPGKGLEWVSILYSGGSTYYADSVKGRFTISRDNSKNTLYLQMNSLRAEDTAVYYCARDLVVYGADYWGQGTLVTVSS | 2892 | ARDLVVYGADY | COV072_Plate3_Kappa_59-P1389 | 2893 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPPFGGGTKVEIK | 2894 | QQLNSYPPP | KAPPA |
| 1.3M | COV072_P3_HC_5-P1369 | 2895 | EVQLLESGGGLVQPGGSLRLSCTASGFTFSTYAMSWVRQAPGKGLEWVSAISDSGGSTYYADSVKGRFTISRDNSKNTLYLQMNSLRAEDTAVYYCAKSKTVERLPYCGGDCFSAIDYWGQGTLVTVSS | 2896 | AKSKTVERLPYCGGDCFSAIDY | COV072_Plate3_Kappa_5-P1389 | 2897 | DIQMTQSPSSLSASVGDRVTITCQASQDISNYLNWYQQKPGKAPKLLIYDASNLETGVPSRFSGSGSGTDFTFTISSLQPEDIATYYCQQYDNLPPFTFGPGTKVHIK | 2898 | QQYDNLPPFT | KAPPA |
| 1.3M | COV072_P3_HC_64-P1369 | 2899 | QVQLVESGGGLVKPGGSLRLSCAASGFTFSDYYMTWIRQAPGKGLEWVSYITTSSSYTNYADSVKGRFTISRDNAKNSLYLQMNSLRAEDTAVYYCARDNITMVRGVIVRPNDGGYYYALDVWGQGTTVTVSS | 2900 | ARDNITMVRGVIVRPNDGGYYYALDV | COV072_Plate3_Kappa_64-P1389 | 2901 | DIQMTQSPSSLSASVGDRVTITCRASQSISSYLNWYQEKPGKAPKLLIYAASSLQSGVPSRFSGSGSGTDFTLTISSLQPEDFATYYCQQSYSTRALTFGGGTKVEIK | 2902 | QQSYSTRALT | KAPPA |
| 1.3M | COV072_P3_HC_67-P1369 | 2903 | EVQLVESGGGLIQPGGSLRLSCAASGFIVSRNYMSWVRQAPGKGLEWVSVIYSGGSTYYADSVKGRFTISRDNSKNTLYLQMNSLRADDTAVYYCTRDPVPGRGDAYWGQGTLVTVSS | 2904 | TRDPVPGRGDAY | COV072_Plate3_Kappa_67-P1389 | 2905 | DIQMTQSPSSLSASVGDRVTITCQASQDISNYLNWYQQKPGKAPKLLIYDASNLETGVPSRFSGSGSGTDFTFTISTLQPEDIATYYCQQYDNLPITFGGGTKVEIK | 2906 | QQYDNLPIT | KAPPA |
| 1.3M | COV072_P3_HC_68-P1369 | 2907 | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKKGQPYCGGDCYFYYFDYWGQGTLVTVSS | 2908 | AKKGQPYCGGDCYFYYFDY | COV072_Plate3_Kappa_68-P1389 | 2909 | DIQMTQSPSSLSASLGDRVTITCQASQDISNYLNWYQQKPGKAPKLLIYDASNLETGVPSRFSGSGSGTDFTFTISSLQPEDIATYYCQQYDNLPPITFGQGTRLEIK | 2910 | QQYDNLPPIT | KAPPA |
| 1.3M | COV072_P3_HC_69-P1369 | 2911 | QVQLVESGGGVVQPGRSLRLSCAASGFTFSSYTMHWVRQAPGKGLEWVAVISYDGSIKYYADSVKGRFTISRDNSKNTLYLQMNSLRAEDTAVYYCARDSDTAMVDYFDYWGQGTLVTVSS | 2912 | ARDSDTAMVDYFDY | COV072_Plate3_Kappa_69-P1389 | 2913 | DIQMTQSPSSLSASVGDRVTITCRASQSISSYLNWYQQKAGKAPKLLIYAASSLQSGVPSRFSGSGSGTDFTLTISSLQPEDFATYYCQQSYSTFMYTFGQGTKLEIK | 2914 | QQSYSTFMYT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 1.3M | COV072_P3_HC_74-P1369 | 2915 | QVQLVESGGGVVQPGRSLRLSCAASGFTFSSYAMHWVRQAPGKGLEWVAVISYDGSNKYYADSVKGRCTISRDNSKNTLFLQMNSLRPEDTAVYYCAKVDLKYSYGLYYFDYWGQGTLVTVSS | 2916 | AKVDLKYSYGLYYFDY | COV072_Plate3_Kappa_74-P1389 | 2917 | DIQMTQSPSSLSASVGDRVTITCRASQSISSYLNWYQQKPGKAPKLLIYAASSLQSGVPSRFSGSGSGTDFTLTISSLQPEDFATYYCQQTYITPPSFGPGTKVDIKK | 2918 | QQTYITPPS | KAPPA |
| 1.3M | COV072_P3_HC_80-P1369 | 2919 | EVQLVESGGGLVQPGGSLRLSCAASGITVSSNYMSWVRQAPGKGLEWVSVIYSGGSTYYADSVKGRVTISRDNSKNTLYLQMNSLRVEDTAVYYCARDLGDYGMDVWGQGTTVTVSS | 2920 | ARDLGDYGMDV | COV072_Plate3_Kappa_80-P1389 | 2921 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIK | 2922 | QQLNSYPPYT | KAPPA |
| 6.2M | COV096_6mo_P1_IGG_A1-P1369 | 2923 | QVQLVQSGAEVKKPGSSVKVSCKASGGTFSTSAISWVRQAPGQGLEWMGGIIPFFGTPNYAQKFQGRVTIIADESTTTAYMELSGLRFEDSAVYYCARREPYGPRDYYYFFGMDVWGPGTTVTVSS | 2924 | ARREPYGPRDYYYFFGMDV | COV096_6mo_P1_Lambda_A1-P1409 | 2925 | QSVLTQPPFASASLGASVTLTCTLSSDYSYYKVDWYQQRPGKGPRFVIRVGPGGIVGSKGDGFPDRFSVLGSGLNRSLTINNIQEEDEGDYHCGADEGSGGTFVGVFGGGTKLTV | 2926 | GADEGSGGTFVGV | LAMBDA |
| 6.2M | COV096_6mo_P1_IGG_A5-P1369 | 2927 | QVQLVESGGGVVQPGRSLRLSCAASGFTFSNYEIHWVRQAPGKGLEWVAGISYDGSTKYYADSVKGRFTISRDNSKNTLYLQMNSLRPEDTAVFYCARAGTTNSDYFDYWGQGTLVTVSS | 2928 | ARAGTTNSDYFDY | COV096_6mo_P1_Lambda_A5-P1409 | 2930 | SYVLTQPPSVSVAPGMTARITCGGNTIGSKSVHWYQQKAGQAPVLVIYYDSDRPSGIPERFSGSNSGNTATLTISRVEAGDEADYYCQVWDSSSVLWVFGGGTKLTVL | 2931 | QVWDSSSVLW | LAMBDA |
| 6.2M | COV096_6mo_P1_IGG_B2-P1369 | 2931 | QVQLVQSGAEVKKPGASVKVSCKASGYTFTSHGINWVRQAPGQGLEWMGWISTYSGNTKYAQKFQGRVTMTTDTSTSTVYMELRSLRSDDAAVYYCARDPPNDILTGYLDHWGQGTLVTVSS | 2932 | ARDPPNDILTGYLDH | COV096_6mo_P1_Lambda_B2-P1409 | 2933 | SYVLTQPPSVSAAPGKTAGITCGGDSIGGKSVHWYQQKPGQAPVLVVYDDSDRPSGIPERFSGSNSGNTATLTISRVEAGDEADYYCQVWDGSSDRHWVFGGGTKLTVL | 2934 | QVWDGSSDRHWV | LAMBDA |
| 6.2M | COV096_6mo_P1_IGG_B5-P1369 | 2935 | QVQLVQSGAEVKKPGASVKVSCKASGYTFSSHDINWVRQATGQGLEWVGWMNPNSGNTGSAQSFQGRVTLTRNASISTAYLELSSLRSEDTAVYFCARGFSLTWYFDLWGRGTLITVSS | 2936 | ARGFSLTWYFDL | COV096_6mo_P1_Lambda_B5-P1409 | 2937 | SYVLTQPPSVSAAPGKTARITCGGNNIGGKNVHWYQQKPGQAPVLVVFDDSDRPSGIPERFSGSNSGNTATLTISRVEAGDEADYYCQLWDSTSDHPDVVFGGGTQLTVL | 2938 | QLWDSTSDHPDVV | LAMBDA |
| 6.2M | COV096_6mo_P1_IGG_B6-P1369 | 2939 | QVQLVQSGAEVKKPGASVKVSCKASGYTFTSYSIHWMRQAPGQGLEWTGIINPSGGGTSYAKKFQGRVTMTRDTSTNTVYMELSSLRSEDTAVYYCAREGSLTGYFDLWGRGTLVTVSS | 2940 | AREGSLTGYFDL | COV096_6mo_P1_Lambda_B6-P1409 | 2941 | SYVLTQPPSVSVAPGKTARITCGGNNIGSKSVHWYQQKPGQAPILVVYDDSDRPSGIPERFSGSNSGNTATLTISRVEAGDEADYYCQVWDSSSDRHVVFGGGTKLTVL | 2942 | QVWDSSSDRHVV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV096_6mo_P1_IGG_C3-P1369 | 2943 | EVQLVESGGGLVKPGGSLRLSCAASGFTFSDYSMTWVRQAPGKGLEWVSFISSSSTYIYYADSVKGRFTISRDNAKSSLYLQMNRLRAEDTAVYYCTRVQVGARGWADYWGQGTLVTVSS | 2944 | TRVQVGARGWADY | COV096_6mo_P1_Lambda_C3-P1409 | 2945 | NFMLTQPLSVSESPGKTVTISCTRSSGSIASNYVQWYQQRPGGAPTTVIYEDTQRPSGVPDRFSGSIDSSSNSASLTISGLKTEDEADYYCQSCDTINWVFGGGTKLTVV | 2946 | QSCDTINWV | LAMBDA |
| 6.2M | COV096_6mo_P1_IGG_C4-P1369 | 2947 | QVQLVESGGGVAQPGRSLRLSCAASGFTFSRYGMHWVRQAPGKGLEWVAVIWHDGSDKYCADFVKGRFTISRDNSKNTLYMQMDSLRAEDTAVYYCARGGRPDHETGIAVLGEYYFDSWGQGTLVTVSS | 2948 | ARGGRPDHETGIAVLGEYYFDS | COV096_6mo_P1_Lambda_C4-P1409 | 2949 | SYVLTQPPSVSVSPGQTARITCSGDAFPLQYGYWYQQKPGQAPVLVIYKDKERPSGISERFSGSSSGTTVTLTISGVQAEDEADYYCQSADTNGVVFGGGTSLTVL | 2950 | QSADTNGVV | LAMBDA |
| 6.2M | COV096_6mo_P1_IGG_D8-P1369 | 2951 | QVQLVQSGAEVKKPGSSVKVSCKASGGTFSMSAISWVRQAPGQGLEWMGGIIPIFGTPNYAQKFQGRVTIAADESTSTAYMELSSLRSEDTAVYYCARDQNQIDPAYRDAFDIWGQGTMVTVSS | 2952 | ARDQNQIDPAYRDAFDI | COV096_6mo_P1_Lambda_D8-P1409 | 2953 | QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSSSWVFGGGTKLTVL | 2954 | CSYAGSSSWV | LAMBDA |
| 6.2M | COV096_6mo_P1_IGG_E4-P1369 | 2955 | QVQLQQWGAGLLKPSETLSLTCAVYGGSLSAYQWIWIRQSPGKGLEWIGEINHSGGSNCNPSLKTRVTMSVDTSKNQFSLRLSSVTAADTGVYYCARVQDLMYSLLYWGQGTLVIVSS | 2956 | ARVQDLMYSLLY | COV096_6mo_P1_Lambda_E4-P1409 | 2957 | SYVLTQPPSVSVAPGQTARITCGGNNIGSKNVHWYQQKPGQAPVLVVYDDSGDEADYYCQVWDSTSDHPGVVFGGGDRPSGIPERFSGSNSGNTATLSISRVEATKLTVL | 2958 | QVWDSTSDHPGVV | LAMBDA |
| 6.2M | COV096_6mo_P1_IGG_F1-P1369 | 2959 | QVQLVQSGAEVKKSGASVKVSCKASGYSFTDYFMHWVRQAPGQGLEWMGWINPNSGGTNYAQKFQGRVTMTRDTSITTAYMELSRLRSDDTAVYYCARTPAPLRHVENYYYYYGLDVWGQGTTVTVSS | 2960 | ARTPAPLRHVENYYYYGLDV | COV096_6mo_P1_Lambda_F1-P1409 | 2961 | QSVLTQPASVSGSPGQSITISCTGTASDVGGYNYVSWYQHHPGKAPTLMIYDVSNRPSGVSNRFSGSKSGNTASLTISGLQAEDEADYYCSSYTRGTTLVLFGGGTTLTVL | 2962 | SSYTRGTTLVL | LAMBDA |
| 6.2M | COV096_6mo_P1_IGG_F4-P1369 | 2963 | QVQLQESGPGLVKPSQTLSLTCTVSGGSISNGDYYWSWIRQHPGKGLEWIGYIYHSGITYYNPSLKSRLMISIDTSKNQFSLKLRSVTAADTAVYYCARFLRNFEWLFFDPWGQGTLVTVSS | 2964 | ARFLRNFEWLFFDP | COV096_6mo_P1_Lambda_F4-P1409 | 2965 | QSVLTQPPSASGSPGQSVTISCTGTSSDVGGYDYVSWYQHHPGKAPKVMIYEVRKRPSGVPDRFSGSKSGNTASLTVSGLQAEDEADYYCSSYVGSNVLFGGGTKLTVL | 2966 | SSYVGSNVL | LAMBDA |
| 6.2M | COV096_6mo_P1_IGG_F6-P1369 | 2967 | QVQLQESGPGLVKPSETLSLTCTVSGASISSHYWSWIRQPPGKGLEWIGYIHYIGSTNYNPSLKSRVTILLDTSKNQFSLRLRSVTAADTAVYYCARGWPYCGVDCYSGFDYWGQGTLVTVSS | 2968 | ARGWPYCGVDCYSGFDY | COV096_6mo_P1_Lambda_F6-P1409 | 2969 | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGLWVFGGGTKLTVL | 2970 | AAWDDSL | LAMBDA |
| 6.2M | COV096_6mo_P1_IGG_G10-P1369 | 2971 | QVQLVQSGAEVKKPGASVKVSCEASGFPFINYFMHWVRQAPGQGLEWMGVINPGGGSTTYPQKFQGRVTMTRDTSTSTVYMELSSLRSEDTAVYYCARGRSRGVGDVYPSVDYWGQGTLVTVSS | 2972 | ARGRSRGVGDVYPSVDY | COV096_6mo_P1_Lambda_G10-P1409 | 2973 | QSVLTQPPSASGTPGQRVTISCSGNSSNIGSNTVSWSQQLPGTAPKLLIYSNHQRPSGVPDRFSGSKSGTSASLAISGLQSEDEADYHCAAWDDSLNGPVFGGGTQLTVL | 2974 | AAWDDSLNGPV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 6.2M | COV096_6mo_P1_IGG_G3-P1369 | 2975 | QLQLQESGPGLVKPSETLSLTCTVSGGSISSSSYYWAWIRQPPGKGLEWIGNIYYSGITYYSPSLKSRVTISVDTSKNQFSLKLRSVTAADTAVYYCARQHRYGSGSSELLWGQGTLVTVSS | 2976 | ARQHRYGSGSSELL | COV096_6mo_P1_Lambda_G3-P1409 | 2977 | QSVLTQPPSASGSPGQSVTISCTGTSSDVGSYNYVSWYQQHPGKAPKLMIYEVTKRPSGVPDRFSGSKSGNTASLTVSGLQADDEADYYCSSYAGSSNLIFGGGTKLTVL | 2978 | SSYAGSSNLI | LAMBDA |
| 6.2M | COV096_6mo_P1_IGG_G5-P1369 | 2979 | EVQLVQSGAEVKKAGEPLKISCRASGYTFTRYWIGWVRQMPGKGLEWMGIIYPHDSDTRYSPSFEGQVTISADKSISTAYLQWSRLKASDTAVYYCARRGGDYPPWFDPWGQGTLVTVSS | 2980 | ARRGGDYPPWFDP | COV096_6mo_P1_Lambda_G5-P1409 | 2981 | QSVLTQPRSVSGSPGQSVTISCTGTSSDFGAYTYVSWYQQRPGKAPKLMIYDVIKRPSGVPDRFSGSKSGNTASLTISGLQADDEADYYCCSYADSYTVIFGGGTKLTVL | 2982 | CSYADSYTVI | LAMBDA |
| 6.2M | COV096_6mo_P1_IGG_G7-P1369 | 2983 | QLQLQESGPGLVKPSETLSLTCTVSGGSITTSSYYWGWIRQPPGKGLEWIGAIYYTGITYYNPSLKSRVTMSVDTSKNQFALRLSSVTAADTAVYYCARQNRFGSGSSELLWGQGTLVTVSS | 2984 | ARQNRFGSGSSELL | COV096_6mo_P1_Lambda_G7-P1409 | 2985 | QSVLTQPPSASGSPGQSVTISCTGTSSDVGSYDYVSWYQQHPGKAPKLVIYEVSERPSGVPDRFSGSKSGNTATLTVSGLQADDEADYYCSSYAGSNNLIFGGGTKLTVL | 2986 | SSYAGSNNLI | LAMBDA |
| 6.2M | COV096_6mo_P1_IGG_H3-P1369 | 2987 | QVQLVQSGAEVKKPGASVKVSCKASGYTFTDYYLHWVRQAPGQGLEWVGWINPISGGTNYAQQFQGRVSMTRHTSITTAYMELSRLRSDDTAVYYCARVYHLLLGEGSWSPLPYYYYGMDVWGQGTTVTVSS | 2988 | ARVYHLLLGEGSWSPLPYYYYGMDV | COV096_6mo_P1_Lambda_H3-P1409 | 2989 | QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSNTFVFGTGTKVTVL | 2990 | CSYAGSNTFV | LAMBDA |
| 6.2M | COV096_6mo_P1_IGG_H9-P1369 | 2991 | EVQLVESGGGLVKPGRSLRLSCTVSGFTFGAYAMSWFRQAPGKGLEWVGFIRSKTYGGTTEYAASLKGRFTISRDDSKSIAFLQMNSLKTEDTAVYFCSRGGYYDGSPYYWNRPDAFDIWGLGTVVTVS | 2992 | SRGGYYDGSPYYWNRPDAFDI | COV096_6mo_P1_Lambda_H9-P1409 | 2993 | QSVLTQPPSASGTPGQRITISCSGSSSNIGSNTVNWYQQLPGTAPKLLIYSNNQRPSGVPDRFSGSKSGTSASLAISGVQSEDEADYYCAAWDDSLNGPDVVFGGGTKLTVL | 2994 | AAWDDSLNGPDVV | LAMBDA |
| 6.2M | COV096_6mo_P2_IGG_A12-P1369 | 2995 | EVQLVESGGGLVKPGRSLRLSCTASGFTFGDYAMSWFRQAPGKGLEWVGFIRSKSYGGTAASVKGRFTISRDDSKSIDYLQMNSLKIEDTAVYYCTRGGYYDGSGFYWNRPDAFDIWGQGTMVTVSS | 2996 | TRGGYYDGSGFYWNRPDAFDI | COV096_6mo_P2_Lambda_A12-P1409 | 2997 | QSVLTQPPSASGTPGQRVTISCSGSSSNIGSNTVNWYQQLPGAAPKLLIYFNNQRPSGVPDRFSGSRSGTSASLAISGLQSEDEADYYCAAWDDSLNGPDVVFGGGTKLTVL | 2998 | AAWDDSLNGPDVV | LAMBDA |
| 6.2M | COV096_6mo_P2_IGG_A6-P1369 | 2999 | QLQLQESGPGLVKPSETLSLTCTVSGGSISNNNYYWAWIRQPPGKGLEWIGNIYYTGITYYNPSLKSRVAISVDMSMNQFSLKLRSVTAADTAVYFCARQNRYGSGSSELLWGQGTLVTVSS | 3000 | ARQNRYGSGSSELL | COV096_6mo_P2_Lambda_A6-P1409 | 3001 | QSVLTQPPSASGSPGQSVTISCTGTSSDVGSYNYVSWYQQHPGKAPKLLIYEVTQRPSGVPDRFSGSKSGNTASLTVSGLQTEDEADYYCSSYAGSNSLVFGGGTKLTVL | 3002 | SSYAGSNSLV | LAMBDA |
| 6.2M | COV096_6mo_P2_IGG_A7-P1369 | 3003 | QVQLVQSGAEVKKPGSSVRVSCKASGGTFSRDALSWVRQAPGQGLEWMGGIIPISDSATYAQKFQGRVTLIADEATATAYMELSSLRSEDTAVYYCARHMVVIPVGLHYYYGMDVWGQGTTVTVSS | 3004 | ARHMVVIPVGLHYYYGMDV | COV096_6mo_P2_Lambda_A7-P1409 | 3005 | QSVLTQPPSVSGAPGQRVTISCTGSGSNIGAGFDVHWYQQLPGTAPKLLIYGNSNRPSGVPDRFSGSKSGTSASLAITGLQAEDEADYYCQSYDSGLSASVFGGGTKLTVL | 3006 | QSYDSGLSASV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV096_6mo_P2_IGG_A9-P1369 | 3007 | QVQLVQSGAEVKKPGSSVKVSCKASGGTFSSYSISWVRQAPGQGLEWMGGIMPILGIANYAQWFQGRVTITADESTSTAYMELSSLRSEDTAVYYCARERGYSDYGSVQYFDYWGQGTLVTVSS | 3008 | ARERGYSDYGSVQYFDY | COV096_6mo_P2_Lambda_A9-P1409 | 3009 | QSVLTQPPSVSGAPGQRVTISCTGSNSNIGAGYDVHWYQQLPGTAPKLLIYADINRPSGVPDRFSGSKSDTSASASLAITGLQAEDEADYYCQSYDSSLSGSVVFGGGTKLTVL | 3010 | QSYDSSLSGSVV | LAMBDA |
| 6.2M | COV096_6mo_P2_IGG_B5-P1369 | 3011 | QVQLVQSGAEVKKPGASVKVSCKASGHTFTTYYLHWVRQAPGQGLEWMGRIDPSGGSTTYAQKFQGRVTMTRDTSTSTVYMELSSLRSEDTALYYCARGGYCGSTSCSPDDYFDYWGQGTLVTVSS | 3012 | ARGGYCGSTSCSPDDYFDY | COV096_6mo_P2_Lambda_B5-P1409 | 3013 | SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYYVFGTGTKVTVL | 3014 | QVWDSSSDHYYV | LAMBDA |
| 6.2M | COV096_6mo_P2_IGG_C3-P1369 | 3015 | QVQLVESGGGVVQPGRSLRLSCAASGFIFSSYGMHWVRQAPGKGLEWVAGIWYDGSNKFYADSVKGRFTISRDNSKNTLYLQMNSLRAEDTAVYFCARDGAVAPAGSLDWFDPWGQGTLVTVSS | 3016 | ARDGAVAPAGSLDWFDP | COV096_6mo_P2_Lambda_C3-P1409 | 3017 | SYVLTQPPSVSVAPGKTARITCGGNYIGSKSVHWYQQKPGQAPVLVIYYDTDRPSGIPERFSGSNSGNTATLTISRVEAGDEADYYCQVWDSSGDHYVFGTGTKVTVL | 3018 | QVWDSSGDHYV | LAMBDA |
| 6.2M | COV096_6mo_P2_IGG_C6-P1369 | 3020 | QLQLQESGPGLVRPSETLSLTCTVSGGSISSSSYYWGWIRQPPGKGLEWIGDMYYSGSTYYTPSLRGRVTISVDTSKNQFSLKLSSVTAADTAVYYCASRGWLRGAFDVWGQGTVATVSS | 3021 | ASRGWLRGAFDV | COV096_6mo_P2_Lambda_C6-P1409 | 3022 | NFMLTQPHSVSESPGKTVTISCTHSSGSIASNYVQWYQQRPGSSPTIVIFEDNQRPSGVPDRFSGSIDSSSNSASLTISGLKTEDEADYYCQSYDSSIHVVFGGGTKLTVL | 3023 | QSYDSSIHVV | LAMBDA |
| 6.2M | COV096_6mo_P2_IGG_C8-P1369 | 3023 | EVQLVESGGGLVQPGRSLRLSCAASGFTFDDYGMHWVRQAPGKGLEWVSGISWNGDSIGYADSVKGRFTISRDNAKTSLYLQMNRLRAEDTALYYCAKAASRSTRIGGAFDIWGQGTMVTVSS | 3024 | AKAASRSTRIGGAFDI | COV096_6mo_P2_Lambda_C8-P1409 | 3025 | QSVLTQPASVSGSPGQSITISCTGTSSDVGGYNLVSWYQQHPGKAPKLMIYEGSKRPSGVSNRFSGSKSGNTASLTISGLQAEDEADYYCCSYAYSFTNVFGTGTKVTV | 3026 | CSYAYSFTNV | LAMBDA |
| 6.2M | COV096_6mo_P2_IGG_C9-P1369 | 3027 | EVQLVESGGDLIQPGGSLRLSCAASGFSVSNSYMSWVRQAPGKGLEWVSIIYSGGSTYYADSVKGRFTISRDNSKNTLYLQMNSLRAEDTAVYFCAKTPRGDYDSSGTSAYWGQGTLVTVSS | 3028 | AKTPRGDYDSSGTSAY | COV096_6mo_P2_Lambda_C9-P1409 | 3029 | QSVLTQSPSASASLGASVNLTCTLSSGHSSYAIAWHQQQPEKGPRFLMKLSSDGSHNKGDGIPDRFSGSSSGAERFLTISSLQSEDEADYYCQTWGIGSDWVFGGGTKLTVL | 3030 | QTWGIGSDWV | LAMBDA |
| 6.2M | COV096_6mo_P2_IGG_D9-P1369 | 3031 | EVQLVESGGGLVKPGGSLRLSCAASGLTFSTTWMSWVRQAPGKGLEWVGRIKSKGDGGTTDFAGPVKGRFSISRDDSKNTLYLHMNSLKTEDTAVYYCTTDDPGSYYYGMDVWGQGTTVTVSS | 3032 | TTDDPGSYYYGMDV | COV096_6mo_P2_Lambda_D9-P1409 | 3033 | QSVLTQEPSLTVSPGGTVTLTCASSTGAVTSGHYPYWFQQKPGQAPRTLIYATSNKHSWTPARFSGSLLGGKAALTLSGAQPEDEADYYCLLSYSGARVFGGGTKLTVL | 3034 | LLSYSGARV | LAMBDA |
| 6.2M | COV096_6mo_P2_IGG_E7-P1369 | 3035 | EVQLVESGGGLVQPGRSLRVSCAASGFTFDDYAMHWVRQAPGKGLEWVSGISWNSGSKAYADSVKGRFTISRDNAKNSLHLQMNSLRAEDKALYYCAKDVSKTGWFGEIANREYYFDYWGQGTLVTVSA | 3036 | AKDVSKTGWFGEIANREYYFDY | COV096_6mo_P2_Lambda_E7-P1409 | 3037 | SYVLTQPPSVSVSPGQTARITCSGDALPNQYVYWYQQKPGQAPLLVIYKDTERPSGIPERFSGSTSGTTVTLTISGVQAEDEADYYCQLADSSGVVFGGGTKLTVL | 3038 | QLADSSGVV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| 6.2M | COV096_6mo_P2_IGG_F4-P1369 | 3039 | EVQLVESGGGLVQPGRSLRLSCAASGFTFDDYAIHWVRQAPGKGLEWVSGVSWNSGTIGYADSVKGRFFISRDNAKNSLYLQMNSLRAEDTAWYYCAKIADLVGAYDFRSGQHFAAFDVWGQGTMVTVSS | 3040 | AKIADLVGAYDFRSGQHFAAFDV | COV096_6mo_P2_Lambda_F4-P1409 | 3041 | QSVLTQPPSASGTPGQRVTISCSGSSSNIGSNTVNWYQHLPGTAPKLLIYSNNQRPSGVPDRFSGSKSGTSASLAISGLQSEDEADYYCASWDDSLVVFGGGTKLTVL | 3042 | ASWDDSLVV | LAMBDA |
| 6.2M | COV096_6mo_P2_IGG_G10-P1369 | 3043 | QVQLQESGPGLVKPSQTLSLNCSVSGGSISSGNYYWSWIRQPAGKGLEWIGHILTRGSTNYNPSLKSRVTISVDTSGNQFSLKLSPVTAADTAVYYCARTDYDILTGYYVYWGQGTLVTVSS | 3044 | ARTDYDILTGYYVY | COV096_6mo_P2_Lambda_G10-P1409 | 3045 | SYVLTQPPSVSVAPGKTARITCGESNIGSKSVHWYQRKPGQAPVLVVYDDSDRPSGIPERFSGSNSGNTATLTISRVEVGDEADYYCQVWDGSSDHFYVFGTGTKVTVL | 3046 | QVWDGSSDHFYV | LAMBDA |
| 6.2M | COV096_6mo_P2_IGG_G3-P1369 | 3047 | EVQLVESGGGLIQPGGSLRLSCAASGFTVSSNYMTWVRQAPGKGLEWVSVVYSGDNTYYADSVKGRFTTSRDNSKNTVFLQMNSLKAEDTALYYCARTQWLRGSFDLWGRGTLVTVSS | 3048 | ARTQWLRGSFDL | COV096_6mo_P2_Lambda_G3-P1409 | 3049 | NFMLTQPHSVSESPGKTVTISCTHSSGSIASNYVQWYQQRPGSSPIIVIYEDNQRPSGVPDRFSGSIDSSSNSASLTISGLKTEDEADYYCQSYDVSNHWVFGGGTRLTVL | 3050 | QSYDVSNHWV | LAMBDA |
| 6.2M | COV096_6mo_P2_IGG_H3-P1369 | 3051 | EVQLVESGGGLVQPGRSLKLSCAASGFTFEDYAMHWVRQAPGKGLEWVSGSTWNSGTIGYSVKGRFTISRDNAKNSLYLQMNRLRAEDTALYYCVKDLYYLGKRRSSVIFEVYGMDVWGQGTAVTVSS | 3052 | VKDLYYLGKRRSSVIFEVYGMDV | COV096_6mo_P2_Lambda_H3-P1409 | 3053 | SYVLTQPPSVSVAPGKTARLTCGGNNIGSKGVHWYQQKPGQAPVLVVYDDSDRPSGLPERFSGSNSGNTASLTISRVEAGDEADYYCQVWDSNSDLVVFGGGTKLTVL | 3054 | QVWDSNSDLVV | LAMBDA |
| 6.2M | COV096_6mo_P2_IGG_H6-P1369 | 3055 | QVQLQESGPGLVKPSQTLSLTCTVSGGSITSGRYYWSWIRQPAGKGLEWIGHIFTSGSTNYNPSLKSRITISVDRSKNQFSLRLSSATAADTAVYFCARGDYESLTGYYDYWGQGTLVTVSS | 3056 | ARGDYESLTGYYDY | COV096_6mo_P2_Lambda_H6-P1409 | 3057 | SYVLTQPPSVSVAPGKTARITCEENDIGSKNVHWYQQKPGQAPVLVVYDDSDRPSGIPERFSGSNSGNTATLTISRVEAGDEADYYCQVWDGSSDHFYVFGTGTKVTVL | 3058 | QVWDGSSDHFYV | LAMBDA |
| 1.3M | COV096_HC_101-P1369 | 3059 | QVQLQESGPGLVKPSQTLSLTCTVSGGSISSGNYYLTWIRQPAGKGLEWIGHIYTSGSTNYNPSLKSRVTISVDTSMNQFSLKLSSVTAADTAVYYCARDIPPTWYFDLWGRGTLVTVSS | 3060 | ARDIPPTWYFDL | COV096_LC_101-P1409 | 3061 | SYVLTQPPSVSVAPGKTARITCGGNNIWDGSKNVHWYQQKPGQAPVLVVYDDSDRPSGIPERFSGSNSGNTATLTISRVEAGDEAGYYCQVWDSTSDHLFWVFGGGTKLTVL | 3062 | QVWDSTSDHLFWV | LAMBDA |
| 1.3M | COV096_HC_103-P1369 | 3063 | QLQLQESGPGLVKPSETLSLTCTVSGGSITSSSYYWGWIRQPPGKGLEWIGTIYYGGSTYYNPSLKSRVTISVDTSKNQISLKLSSVTAADTAVYYCASLRGAYYDFWSGPRDGGWFDPWGQGTLVTVSS | 3064 | ASLRGAYYDFWSGPRDGGWFDP | COV096_LC_103-P1409 | 3065 | QXXXTQPASVSGSPGQSITISCTGTSSDVGSYNLVSWYQQHPGKAPKLMIYEDSKRPSGVSNRFSGSKSGNTASLTISGLQAEDEADYYCCSYAGSSLWVFGGGTKLTVL | 3066 | CSYAGSSLWV | LAMBDA |
| 1.3M | COV096_HC_104-P1369 | 3067 | EVQLVESGGGLVKPGGSLRLSCAASGFTFSSYSMNWVRQAPGKGLEWVSFISSRSSYIYYADSVKGRFTISRDNAKNSLYLQMNSLRAEDTAVYYCARVQVGARGWVDYWGQGTLVTVSS | 3068 | ARVQVGARGWVDY | COV096_LC_104-P1409 | 3069 | NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSINWVFGGGTKLTVL | 3070 | QSYDSINWV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV096_HC_10-P1369 | 3071 | QVQLVQSGAEVKKPGASVRVSCKASGYTFTGYYIHWVRQAPGQGLEWMGWINPMSGGTNYTQKFQGWVTMTRDTSINTAYMELSRLRSDDTAVYYCARDFAMGTVTGTFVYWGQGTLVTVSS | 3072 | ARDFAMGTVTGTFVY | COV096_LC_10-P1409 | 3073 | QXXLTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGTGTKVTVL | 3074 | SSYAGSNNWV | LAMBDA |
| 1.3M | COV096_HC_111-P1369 | 3075 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVQVGARGWVDYWGQGTLVTVSS | 3076 | ARVQVGARGWVDNW | COV096_LC_111-P1409 | 3077 | NFMLTQPHSVSESPGKTVTISCTRSSGSIASNYVQWYQQRPGSAPTTVIYEDNERPSGVPDRFSGSIDSSSNSASLTISGLKTEDEADYYCQSYDRINWVFGGGTKLTVL | 3078 | QSYDRINWV | LAMBDA |
| 1.3M | COV096_HC_116-P1369 | 3079 | QVQLVQSGAEVKKPGASVKVSCKASGYTVTGYYIHWVRQAPGQGLEWMGWISPNSGGTNYAQKFQGWVTMTRDMSITTAYMELSRLRSDDTAVYYCARERYFDLGGMDVVVGQGTTVTVSS | 3080 | ARERYFDLGGMDV | COV096_LC_116-P1409 | 3081 | QSALTQPASVSGSPGQSITISCTGTSSDVGSYNLVSWYQQHPGKAPKLMIYEDSKRPSGVSNRFSGSKSGNTASLTISGLQAEDEADYYCCSYAGSSTRLFGGGTKLTVL | 3082 | CSYAGSSTRL | LAMBDA |
| 1.3M | COV096_HC_121-P1369 | 3083 | EVQLVESGGGLIQPGGSLRLSCAASGFTVSSNYMSWVRQAPGKGLEWVSVISSGGGTFYADSVKGRFTISRDNSKNTLYLQMNSLRAEDTAVYYCARSLWLRGSFQHWGQGTLVTVSS | 3084 | ARSLWLRGSFQH | COV096_LC_121-P1409 | 3085 | NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSSWVFGGGTKLTVL | 3086 | QSYDSSSWV | LAMBDA |
| 1.3M | COV096_HC_130-P1369 | 3087 | EVQLVESGGGLVQPGRSLRLSCAASGFTFDDYAMHWVRQVPGKGLEWVSGISWNSASIGYADSVKGRFTISRDNAKNSLYLQMNSLRPEDMAFYYCAKGSSSGWTRPLDYWGQGTLVTVSS | 3088 | AKGSSSGWTRPLDY | COV096_LC_130-P1409 | 3089 | SYXLTQPPSVSVAPGKTARITCGGNNIGSKSVHWYQQKPGQAPVLVVYDDSDRPSGIPERFSGSNSGNTATLTISRVEAGDEADYYCQVVVDSSSDPVVFGGGTKLTVL | 3090 | QVWDSSSDPVV | LAMBDA |
| 1.3M | COV096_HC_136-P1369 | 3091 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARREAYGPRDYYYYYGMDVWGQGTTVTVSS | 3092 | ARREAYGPRDYYYYGMDV | COV096_LC_136-P1409 | 3093 | QSXXTQPPSASASLGASVTLTCTLSSGYSNYKVDWYQQRPGKGPRFVMRVGTGGIVGSKGDGIPDRFSVLGSGLNRYLTIKNIQEEDESDYHCGADQGSGSNFVGVFGGGTKLTVL | 3094 | GADQGSGSNFVGV | LAMBDA |
| 1.3M | COV096_HC_138-P1369 | 3095 | QVQLVQSGAEVKKSGASVKVSCKASGYTFTSYDINWVRQATGQGLEWMGWMNPNSGNTGYAQKFQGRVTMTRNTSISTAYMDLSSLRSEDTAVYYCARGFSLTWYFDLWGRGTLVTVSS | 3096 | ARGFSLTWYFDL | COV096_LC_138-P1409 | 3097 | SYXLTQPPSVSVAPGKTARITCGGNNIGSKSVHWYQQKPGHAPVLVVYDDSDRPSGIPERFSGSNSGNTATLTISRVEAGDEADYYCQVWDSTGGHPDVVFGGGTKLTVL | 3098 | QVWDSTGGHPDVV | LAMBDA |
| 1.3M | COV096_HC_142-P1369 | 3099 | EVQLVESGGGLVQPGGSLRLSCAASRFTFSSYWMSWVRQAPGKGLEWVANIKQDGSEKYYVDSVKGRFTISRDNAKNSLYLQMNSLRAEDTAVYYCATAPWLRGGFDYWGQGTLVTVSS | 3100 | ATAPWLRGGFDY | COV096_LC_142-P1409 | 3101 | NFMLTQPHSVSESPGKTVTISTRSSGSIASNYVQWYQQRPGSSPTTVIYEDSQRPSGVPDRFSGSIDSSSNSASLTISGLKTEDEADYYCQSFDSTNLWVFGGGTKLTVL | 3102 | QSFDSTNLWV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV096_HC_149-P1369 | 3103 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGGYSYGYSLYYFDYWGQGTLVTVSS | 3104 | AKGGYSYGYSLYYFDY | COV096_LC_149-P1409 | 3105 | QXXXTQPASVSGSPGQSITISCTGTSSDVGGYNYVSWHQQHPGKAPKLMIYDVSNRPSGVSNRFSGSKSGNTASLTISGLQAEDEADYYCSSYTSSSTLVFGGGTKLTVL | 3106 | SSYTSSSTLV | LAMBDA |
| 1.3M | COV096_HC_152-P1369 | 3107 | QVQLVQSGAEVKKPGASVKVSCKASGYTFTSYDINWVRQATGQGLEWMGWMNPNSGNTGYAQKFQGRVTITRDTSISTAYMELSSLRXEDTAVYYCARGGRYCSDVSCYSGTGFDYWGQGTLVTVSS | 3108 | ARGGRYCSDVSCYSGTGFDY | COV096_LC_152-P1409 | 3109 | QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYWVFGGGTKLTVL | 3110 | AAWDDSLSGYWV | LAMBDA |
| 1.3M | COV096_HC_157-P1369 | 3111 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKAQYSYGYVVYYFDYWGQGALVTVSS | 3112 | AKAQYSYGYVVYYFDY | COV096_LC_157-P1409 | 3113 | NFMLTQPHSVSESPGKTVTISCTRSSGSIASNYVQWYQQRPGSSPTIVIYEDNQRPSGVPDRFSGSIDSSSNSASLTISGLKTEDEADYYCQSYDSSNVVFGGGTKLTVL | 3114 | QSYDSSNVV | LAMBDA |
| 1.3M | COV096_HC_159-P1369 | 3115 | EVQLVESGGGLIQPGRSLRLSCAASGFTFDDYAMHWVRQAPGKGLEWVSGTSWNSGTIGYADSVKGRFTISRDNAKNSLYLQMNRLRAEDTALYHCAKDIGSKRSTSENYGMDVWGQGTTVTVSS | 3116 | AKDIGSKRSTSENYGMDV | COV096_LC_159-P1409 | 3117 | SYVLTQPPSVSVAPGKTARITCGGNNIGSKSVHWYQQKPGQAPVLVVYDDSDRPSGIPERFSGSNSGNTATLTISKVEAGDEADYYCQVWDSSSDSVVFGGGTKLTVL | 3118 | QVWDSSSDSVV | LAMBDA |
| 1.3M | COV096_HC_15-P1369 | 3119 | EVQLVESGGGLVQPGRSLRLSCAASGFTFDDYAMHWVRQAPGKGLEWVSGISWNSGIIGYADSVMGRFTISRDNAKNSLYLQMNSLRAEDTALYYCAKDGGSGTTEYEAYYFDYWGQGTLVTVSS | 3120 | AKDGGSGTTEYEAYYFDY | COV096_LC_15-P1409 | 3121 | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVL | 3122 | AAWDDSLNGVV | LAMBDA |
| 1.3M | COV096_HC_174-P1369 | 3123 | EVQLVQSGAEVKKPGESLKISCKGSGYSFTSHWIGWVRQMPGKGLEWMGIIYPGDSDTRYSPSFQGQVTISADKSISTAYLQWSSLKASDTAMYYCARLPSGRYNWFDPWGQGTLVTVSS | 3124 | ARLPSGRYNWFDP | COV096_LC_174-P1409 | 3125 | QSXXTQPPSASGTPGQRVTISCSGSSSNIGSNTVNWYQQLPGTAPKLLIYSNNSEDEADYYCAAWDDSLNGHVVFGGGTKLTVL | 3126 | AAWDDSL | LAMBDA |
| 1.3M | COV096_HC_176-P1369 | 3127 | QVQLVQSGAEVKKPGASVKVSCKASGYTFTSYDVNWVRQATGQGLEWMGWMNPNSGSAGYAQKFQGRVTMTRNTSISTAYMELSSLRSEDTAVYYCARGFSLTWYFDLWGRGTLVTVSS | 3128 | ARGFSLTWYFDL | COV096_LC_176-P1409 | 3129 | SYXLTQPPSVSVAPGKTARITCGGNNIGSKSVHWYQQKPGQAPVLVVYDDSD?RPSGIPERFSGSNSGNTATLTISRVEAGDEADYYCQVWDSTSDHPDVVFGGGTKLTVL | 3130 | QVWDSTSDHPDVV | LAMBDA |
| 1.3M | COV096_HC_189-P1369 | 3131 | EVQLVQSGAEVKKPGESLKISCKGSGYSFTSYWIGWVRQMPGKGLEWMGIIYPGDSDTTYSPSFQGQVTISADKSVTTAYLQWSSLKASDTAMYYCARLPQEEKRFLEWLPPANVRKQIPYYYGMDVWGQGTTVTVSS | 3132 | ARLPQEEKRFLEWLPPANVRKQIPYYYGMDV | COV096_LC_189-P1409 | 3133 | QSXLTQPPSVSGAPGQRVTISCTGSSSNIGADYDVHWYQQLPGTAPKLLIYGNSNRPSGVPDRFSGSKSGTSASLAITGLQAEDEADYYCQSYDSSLSGPYWVFGGGTKLTVL | 3134 | QSYDSSLGPYWV | LAMBDA |
| 1.3M | COV096_HC_ | 3135 | EVQLVESGGGLVQPGRSLRLSCAASGFTFDDYAMHWVRQAPGKGLEWVSGVSWNSGTIGY | 3136 | AKIADIVRAYDFW | COV096_LC_ | 3137 | QSALTQPPSASGTPGQRVTISCSGSSSNIGSNTVNWYQQLPGTAPKLLIYSNN | 3138 | AAWD | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | 1-P1369 | | ADSVKGRFTISRDNAKNSLYLQMNSLRAEDTALYYCAKIADIVRAYDFWSGQHFDAFDIWGQGTMVTVSS | | SGQHFDAFDI | 1-P1409 | | QRPSGVPDRFSGSKSGTSASLAISGLQSEDEADYYCAAWDDSLVVFGGGTKLTVL | | DSLVV | |
| 1.3M | COV096_HC_20-P1369 | 3139 | EVQLVESGGGLVQPGRSLRLSCAASGFTFDDYAMHWVRQAPGKGLEWVSGISWNSGTIGYADSVQGRFIISRDNAKNSLYLQMNSLRAEDTALYYCAKDMGRDDSSGSLLFDYWGQGTLVTVSS | 3140 | AKDMGRDDSSGSLLFDY | COV096_LC_20-P1409 | 3142 | SYVLTQPPSVSVAPGKTARITCGGNNIGSKSVHWFQQKPGQAPVLVVYDDSDRPSGIPERFSGSNSGNTATLTISRVEAGDEADYYCQVWDSSSDHVVFGGGTKLTVL | 3143 | QVWDSSSDHVV | LAMBDA |
| 1.3M | COV096_HC_23-P1369 | 3143 | QVQLQESGPGLVKPSQTLSLTCTVSGGSISSGSYYWSWIRQPAGKGLEWIGHIYTSGSTNYNPSLKSRVTISVDTSKNQFSLKLSSVTAADTAVYYCAREIPSTWYFDLWGRGTLVTVSS | 3144 | AREIPSTWYFDL | COV096_LC_23-P1409 | 3145 | QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYWVFGGGTKLTVL | 3146 | AAWDDSLSGYWV | LAMBDA |
| 1.3M | COV096_HC_27-P1369 | 3147 | EVQLVESGGGLVQPGGSLRLSCAASGFTFSSYWMSWVRQAPGKGLEWVATIKQDGSEKYYVDSVKGRFTISRDNAKNSLYLQMNSLRAEDTAVYYCARGDYDFWSGYYDYWGQGTLVTVSS | 3148 | ARGDYDFWSGYYDY | COV096_LC_27-P1409 | 3149 | SYXLTQPPSVSVSPGQTARITCSGDAFPNQYAYWYQQKPGQAPVLVIYKDSERPSGIPERFSGSSSGTTVTLTISGVQAEDEADYYCQSADSSSWVFGGGTKLTVL | 3150 | QSADSSSWV | LAMBDA |
| 1.3M | COV096_HC_2-P1369 | 3151 | QVQLVQSGAEVKKPGASVKVSCKASGYTFTSYYMHWVRQAPGQGLEWMGIINPSGGSTRYAQKFQGRVTMTRDTSTSTVYMELSSLRSEDTAVYYCAREGVGGTSYFDYWGQGTLVTVSS | 3152 | AREGVGGTSYFDY | COV096_LC_2-P1409 | 3153 | SYVLTQPPSVSVAPGKTARITCGGNNIGSKSVHWYQQKPGQAPVLVVYDDSDRPSGIPERFSGSNSGNTATLTISRVEAGDEADYYCQVWDSSSDPYVFGTGTKVTVL | 3154 | QVWDSSSDPYV | LAMBDA |
| 1.3M | COV096_HC_30-P1369 | 3155 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGLSGHFPHNWFDPWGQGTLVTVSS | 3156 | ARDGLSGHFPHNWFDP | COV096_LC_30-P1409 | 3157 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLRGVFGGGTKLTVL | 3158 | QSYDSSLRGV | LAMBDA |
| 1.3M | COV096_HC_40-P1369 | 3159 | QVQLVESGGGVVQPGRSLRLSCAASGFTFSSYAMHWVRQAPGKGLEWVALISYDGSNKHYADSVKGRFTISRDNSKNTLYLQMNSLRAEDTAVYYCARAGTTNSDYFDYWGQGTLVTVSS | 3160 | ARAGTTNSDYFDY | COV096_LC_40-P1409 | 3161 | SYVLTQPPSVSVAPGKTARITCGGNNIGSKSVHWYQQKPGQAPVLVIYYDTDRPSGIPERFSGSNSGNTATLTISRVEAGDEADYYCQVWDSSSALWVFGGGTKLTVL | 3162 | QVWDSSSALWV | LAMBDA |
| 1.3M | COV096_HC_44-P1369 | 3163 | EVQLVESGGGLVQPGRSLRLSCAASGFTFDDYAMHWVRQVPGKGLEWVSGISWNSASIGYADSVKGRFTISRDNAKNSLYLQMNSLRPEDMAFYYCAKGSSSGWTRPLDYWGQGTLVTVSS | 3164 | AKGSSSGWTRPLDY | COV096_LC_44-P1409 | 3165 | SYVLTQPPSVSVAPGKTARITCGGNNIGSKSVHWYQQKPGQAPVLVVYDDSDRPSGIPERFSGSNSGNTATLTISRVEAGDEADYYCQVWDSSSDPVVFGGGTKLTVL | 3166 | QVWDSSSDPVV | LAMBDA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV096_HC_50-P1369 | 3167 | EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDLGYCSSTNCYYYYWGQGTLVTVSS | 3168 | TTDLGYCSSTNCYYYY | COV096_LC_50-P1409 | 3169 | SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPVFGGGTKLTVL | 3170 | QVWDSSSDHPV | LAMBDA |
| 1.3M | COV096_HC_52-P1369 | 3171 | QVQLVQSGAEVKKPGASVKVSCKASGYTFTDYYMHWVRQAPGQGLEWMGWINPNSGGTNYAQKFQGRVTMTRDTSISTAYMELSRLRSDDTAVYYCASGIGHNWNYVSTPNGMDVWGQGTTVTVSS | 3172 | ASGIGHNWNYVSTPNGMDV | COV096_LC_52-P1409 | 3173 | NFMLTQPHSVSESPGKTVTISCTRSSGSIASNYVQWYQQRPGSAPTTVIYEDYQRPSGVPDRFSGSIDSSSNSASLTISGLKTEDEADYYCQSYDSGVVFGGGTKLTVL | 3174 | QSYDSGVV | LAMBDA |
| 1.3M | COV096_HC_71-P1369 | 3175 | QVQLVQSGAEVKKPGASVKVSCKASGYTFTGYSMHWVRQAPGQGLEWMGWINPNSGGTNYAQKFQGRVTMTRDTSISTAYMELSRLGSDDTAVYYCARDLEYCSSTSCYTSTTFDYWGQGTLVTVSS | 3176 | ARDLEYCSSTSCYTSTTFDY | COV096_LC_71-P1409 | 3177 | SYVLTQPPSVSVAPGKTARITCGGNNIGSKSVHWYQQKPGQAPVLVVYDDSDRPSGIPERFSGSNSGNTATLTISRVEAGDEADYYCQVWDYGVVFAGGTKLTVL | 3178 | QVWDYGVV | LAMBDA |
| 1.3M | COV096_HC_77-P1369 | 3179 | QVQLVQSGAEVKKPGASVKVSCKASGYTVTGYYIHWVRQAPGQGLEWMGWISPNSGGTNYAQKFQGWVTMTRDMSITTAYMELSRLRSDDTAVYYCAREPYFDLGGMDVWGQGTTVTVSS | 3180 | AREPYFDLGGMDV | COV096_LC_77-P1409 | 3181 | QSXLTQPASVSGSPGQSITISCTGTSSDVGSYNLVSWYQQHPGKAPKLMIYEGSKRPSGVSNRFSGSKSGNTASLTISGLQAEDEADYYCCSYAGSSTRVFGGGTKLTVL | 3182 | CSYAGSSTRV | LAMBDA |
| 1.3M | COV096_HC_90-P1369 | 3183 | QVQLVQSGAELKKPGASVKVSCKASGYTFNSYGISWVRQAPGQGLEWMGGISAYNGNTNYAQKLQGRVTMTTDTSTSTAYMELRSLRSDDTAVYYCARRVEDNGDDGGDYYYYYGMDVWGQGTTVTVSS | 3184 | ARRVEDNGDDGGDYYYYYGMDV | COV096_LC_90-P1409 | 3185 | SYVLTQPPSVSVSPGQTARITCSGEALPKQYAYWYQQKPGQAPVMVIYKDSERPSGIPERFSGSSSGTTVTLTISGVQAEDDADYYCQSADSSGTLVVFGGGTKLTVL | 3186 | QSADSSGTLVV | LAMBDA |
| 1.3M | COV096_HC_92-P1369 | 3187 | EVQLVESGGGLVKPGGSLRLSCAASGFTFSNAWMSWVRQAPGKGLEWVGRIKSKTDGGTTDYAAPVKGRFTISRDDSKNTLYLQMNSLK1EDTAVYYCTTDDPGSYYYGMDVWGQGTTVTVSS | 3188 | TTDDPGSYYYGMDV | COV096_LC_92-P1409 | 3189 | QSVLTQEPSLTVSPGGTVTLTCGSSTGAVTSGHYPYWFQQKPGQAPRTLIYDTSNKHSWTPARFSGSLLGGKGALTLSGAQPEDEAEYYCLLSYSGARVFGGGTKLTVL | 3190 | LLSYSGARV | LAMBDA |
| 1.3M | COV096_HC_99-P1369 | 3191 | QVQLVQSGAEVKKPGSSVKVSCKASGGTFSSYAISWGRQAPGQGLEWMGGIIPILGTVNYAQKFQGRVTITADKSTSTAYMELSSLRSEDTAVYYCARVLGYYDSSGSNDAFDIWGQGTMVTVSS | 3192 | ARVLGYYDSSGSNDAFDI | COV096_LC_99-P1409 | 3193 | QSXXTQPPSVSGAPGQRVTISCTGSSSNIGAGYDVHWYQQLPGTAPKLLIYANINRPSGVPDRFSGSKSGTSASLAITGLQAEDEADYYCQSYDSSLSGSVFGGGTKLTVL | 3194 | QSYDSSLSGSV | LAMBDA |
| 6.2M | COV096_6mo_P1_IGG_A10-P1369 | 3195 | EVQLVESGGSLVKPGGSLRLSCVASGLTFNHAWMSWVRQAPGKGLEWVGRIKSKIDGGTTDYAAPVKGRFTISRDDSKSTQYLQMNSLKTEDTAVYYCTTDCFWRLGGTTCYEHDAFDVWGQGTMVTVSS | 3196 | TTDCFWRLGGTTCYEHDAFDV | COV096_6mo_P1_Kappa-A10-P1389 | 3197 | DIQMTQSPSSLSASVGDRVTITCRASQAIATFLNWYQQKPGKAPKLLIYAASSLQSGVPSRFSGSGSGTDFTLTISNLQPEDFATYYCQQSYNSLHFGGGTQVEMK | 3198 | QQSYNSLH | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV096_6mo_P1_IGG_A11-P1369 | 3199 | EVQLVESGGGLAQPGGSLRLSCAASGFTFSSTYDMHWVRQTTGKGLEWVSAIGTAGDTYYPDSVKGRFTISREDAKNSLYLQMNSLRAGDTAVYYCARGHHSPICSSSRCSYYYYFDVWGQGTAVTVSS | 3200 | ARGHHSPICSSSRCSYYYYFDV | COV096_6mo_P1_Kappa-A11-P1389 | 3201 | DIQMTQSPSSLSASVGDRVTITCRASQSITSYLNWYQQKPGKAPKLLIYAASSLQSGVPSRFSGSGSGTDFTLTISSLQPEDFATYYCQQSYTTHMYTFGQGTKLEIK | 3202 | QQSYTTHMYT | KAPPA |
| 6.2M | COV096_6mo_P1_IGG_A2-P1369 | 3203 | EVQLVESGGGLVQPGGSLRLSCAASGFTFSRYDMHWVRQGTGKGLEWVSAIGTSGDTYYPDSVKGRFTISRENAKNSLYLQMNSLRAGDTAVYYCARGGLQTTTWLFDYWGQGTLVTVSS | 3204 | ARGGLQTTTWLFDY | COV096_6mo_P1_Kappa-A2-P1389 | 3205 | DIQMTQSPSSLSASVGDRVTITCRASQSISRYLNWYQQKPGKAPKLLIYAASSLQSGVPSRFSGSGAGTDFTLTISSLQPEDFAIYYCQQSYSNPPITFGQGTRLEIK | 3206 | QQSYSNPPIT | KAPPA |
| 6.2M | COV096_6mo_P1_IGG_A4-P1369 | 3207 | EVQLLESGGSLVQPGGSLRLSCAASGFTFSSYAMSWVRQAPGKGLEWVSTISGGGDSTYYADSVKGRFTISRDNSKNTLYLQMNSLRAGDTAVYYCAKTSSTYYDTLTGEVNFDYWGQGTLVTFAVYYCQQRYNWPLTFGGGTKVEIKVSS | 3208 | AKTSSTYYDTLTGEVNFDY | COV096_6mo_P1_Kappa-A4-P1389 | 3209 | EIVLTQSPATLSLSPGERATLSCRASQSISNYLAWYQQRPGQAPRLLIYDASTRATGIPARFSGSGSGTDFTLTISSLEPEDFAVYYCQQRYNWPLTFGGGTKVEIK | 3210 | QQRYNWPLT | KAPPA |
| 6.2M | COV096_6mo_P1_IGG_A9-P1369 | 3211 | EVQLVESGGGLVKPGGSLRLSCAASGFTFSSYNMNWVRQAPGKGLEWVSLISSTSSHIYYADSVKGRFTISRDNAKNSLYLQMDSLRAEDTAVYYCAREGAPPYCSGGSCYSLYYDDACDIWGQGTRVTVSS | 3212 | AREGAPPYCSGGSCYSLYYDDACDI | COV096_6mo_P1_Kappa-A9-P1389 | 3213 | EIVLTQSPGTLSLSPGERATLSCRTSQTVSSSYLAWYQQKPGQAPRLLIYGASSRATGIPDRFSGSGSGTDFTLTISRLEPEDFAVYYCQQYGGSPRTFGQGTKVEIK | 3214 | QQYGGSPRT | KAPPA |
| 6.2M | COV096_6mo_P1_IGG_B12-P1369 | 3215 | EVQLVQSGAEVKKPGESLKISCKGSGYRFTSYWIGWVRQMPGKGLEWMGIIYPGDSDTRYSPSFQGQVTISADKSISTAYLQWSSLKASDTAMYYCARCSSSSGRSFHQYSMDVWGQGTTVTVSP | 3216 | ARCSSSSGRSFHQYSMDV | COV096_6mo_P1_Kappa-B12-P1389 | 3217 | DIQMTQSPSSLSASVGDRVTITCRASQSISTFLNWYQQKPGKAPKLLIYTASSLQSGVPSRFSGSGSGTDFTLTIRSLQPEDFATYYCQQTDSNPPHSFGQGTKLEI | 3218 | QQTDSNPPHS | KAPPA |
| 6.2M | COV096_6mo_P1_IGG_B4-P1369 | 3219 | EVQLVESGGGLVQPGRSLRLSCAASGFTFDDYDMHWVRQAPGKGLEWVSGISWNSGNIGYADSVKGRFTISRDNAKNSLYLQMSSLRAEDTALYYCAKVCGGILPENRWGYTGYDHSPCSDYWGQGTLVTVSS | 3220 | AKVCGGILPENRWGYTGYDHSPCSDY | COV096_6mo_P1_Kappa-B4-P1389 | 3221 | EIVLTQSPATLSLSPGERATLSCRASQSVSNFLAWYQQKPGQAPRLLIYDASNRATGIPARFSGSGSGTDFTLTISSLEPEDFAVYYCQQRRNWLTFGGGTKVEIK | 3222 | QQRRNWLT | KAPPA |
| 6.2M | COV096_6mo_P1_IGG_B7-P1369 | 3223 | QVQLVQSGAEVKKPGSSVKVSCKASGGTFSRHVISWVRQAPGQGLEWMGGIIPMFGTANYAQKFQGRVTITADESTSTAYMELSSLRSEDTAVYYCAREDFILVSAPIRENSYYYYGMDVVVGQGTTVTVSS | 3224 | AREDFILVSAPIRENSYYYYGMDV | COV096_6mo_P1_Kappa-B7-P1389 | 3225 | EIVLTQSPGTLSLSPGERATLSCRASQSVSSNYLAWYQQKPGQAPRLLIYDASSRATGIPDRFSGSGSGTDFTLTISRLEPEDFAVYYCQQYGGSPRTFGQGTKVEIK | 3226 | QQYGGSPRT | KAPPA |
| 6.2M | COV096_6mo_P1_IGG_B8-P1369 | 3227 | EVQLLESGGGLVQPGGSLRLSCAASGFTFSNYVMNWVRQAPGKGLEWVSAISGSAGATNYADSVMGRFTISRDNSKNTLYLQMNGLRAEDTAVYFCAKTGPSQGDYWGLGTLVSVSS | 3228 | AKTGPSQGDY | COV096_6mo_P1_Kappa-B8-P1389 | 3229 | DIVMTQSPDSLAVSLGERATINCKSSQSLLYSSNNKNYLAWYQQKPGQPPKRLIYWASTRESGVPDRFSGSGSGTDFTLTISSLQAEDVAVYYCQQYYSWCSFGQGTKLEIK | 3230 | QQYYSWCS | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV096_6mo_P1_IGG_C10-P1369 | 3231 | EVQLVESGGGLVQPGGSLRVSCAASGLTVSYNYMTWVRQIPGKGLDWVSVIYPGGSTFYADAVRGRFTISRDNSKNTLYLQMNGLRVEDTAVYYCARESYGLDVWGQGTTVTVSS | 3232 | ARESYGLDV | COV096_6mo_P1_Kappa-C10-P1389 | 3233 | EIVLTQSPGTLSLSPGERATLSCRASQGISSNYLAWYQQKPGQAPRLLIYGASSRATGIPDRFSGSGSGTDFTLTISRLEPEDFAVYYCQLYGSSSGYTFGQGTKLEIK | 3234 | QLYGSSSGYT | KAPPA |
| 6.2M | COV096_6mo_P1_IGG_C12-P1369 | 3235 | EVQLVESGGGLIQPGGSLRLSCAASGITVSSNYMTWVRQAPGKGLEWVSLIYAGGSTFYAESVKGRFIISRDNSNNTVYLQMNSLRADDTAVYYCARDLDYYGMDVWGQGTTVTVSS | 3236 | ARDLDYYGMDV | COV096_6mo_P1_Kappa-C12-P1389 | 3237 | DIQLTQSPSFLSASVGDRVTITCRASQGISSYLAWYQQKPGKAPKLLIYAASTLQSGVPSRFSGSGSGTEFTLTISSLQPEDFATYYCQQLGSSPVCFGPGTKLDI | 3238 | QQLGSSPVC | KAPPA |
| 6.2M | COV096_6mo_P1_IGG_C1-P1369 | 3239 | EVQLVESGGGLVQPGGSLRLSCAASGFTFRNYDMHWVRQVAGKGLEWVSGIGTAGDTYYPDSVKGRFTISRENAKNSVYLQMNNLRAGDTAVYFCARDREISGWTGWYFDLWGRGTLVIVSS | 3240 | ARDREISGWTGWYFDL | COV096_6mo_P1_Kappa-C1-P1389 | 3241 | DIQMTQSPSSLSASVGDRVTITCRASQTIHNYLNWYHQIPGKPPRLLIYTTNNLQSGVPSRFSGSGSGTDFTLTITGLQPEDFATYYCQQSYSTPPITFGQGTRLEIK | 3242 | QQSYSTPPIT | KAPPA |
| 6.2M | COV096_6mo_P1_IGG_C5-P1369 | 3243 | QVQLVESGGGVVQPGRSLRLSCAASGFTFSSSGMHWVRQAPGKGLEWVAVISYDGSNKYYEDSVKGRFTISRDNSKNTLYLQLNNLRVEDTAVYYCARDTPGGDDIMTGWGLYGMDVWGQGTTVTVSS | 3244 | ARDTPGGDDIMTGWGLYGMDV | COV096_6mo_P1_Kappa-C5-P1389 | 3245 | DIQMTQSPSSLSASVGDRVTITCRSSQSISRYLNWYQHKPGKAPKLLIYAAISLQSGVPSRFSGDGSGTDFTLTISSLQLEDXAHSSCQHSYSTPSTFGQGHKGAI | 3246 | QHSYSTPST | KAPPA |
| 6.2M | COV096_6mo_P1_IGG_C8-P1369 | 3247 | EVQLVESGGGLVQPGGSLRLSCAASGFTFRNYDMHWLLQVAGKGLEWVSAIGTSGDTYYPDSVKGRFTISRENAKNSVYLQMNNLRAGDTAVYFCVRDREISGWTGWYFDLWGRGTLVIVSS | 3248 | VRDREISGWTGWYFDL | COV096_6mo_P1_Kappa-C8-P1389 | 3249 | DIQMTQSPSSLSASVGDRVTITCRASQTIHNYLNWYQQIPGKAPRLLIYATNTLQSGVPSRFSGSGSGTDFTLTITGLQPEDFATYYCQQSYSTPPITFGQGTRLEIK | 3250 | QQSYSTPPIT | KAPPA |
| 6.2M | COV096_6mo_P1_IGG_D11-P1369 | 3251 | QVQLVQSGAEVKKPGASVKVSCKASGYTFTDYYIHWVRQAPGQGLEWMGWINPKTGGINFAQKFQGRVTMTRDSSITTVYMELSRLTSDDTAIYYCATDDGGSWSGSSWFDPWGQGTLVTVSS | 3252 | ATDDGGSWSGSSWFDP | COV096_6mo_P1_Kappa-D11-P1389 | 3253 | DIQMTQSPSSLSASVGDRVTITCRASQSISSDLNWYRQKPGKAPRLLIYAASSLQSGVPSRFSGSGSGTDFTLTISSLQPEDFATYYCQQSYSTPPFTFGPGTKVDIK | 3254 | QQSYSTPPFT | KAPPA |
| 6.2M | COV096_6mo_P1_IGG_D12-P1369 | 3255 | QVQLVESGGGVVQPGRSLRLSCAASGFTFSTYGMNWVRQAPGKGLEWVALILYDGSDKYYADSVKSRFTISRDNSRNTLYLQMTSLRAEDTAVYYCAKALSSTYYYDASGPDAFDIWGQGTMVTVSA | 3256 | AKALSSTYYYDASGPDAFDI | COV096_6mo_P1_Kappa-D12-P1389 | 3257 | DIQMTQSPSTLSASVGDRVTITCRASQSISSWLAWYQQKPGKAPKLLIYKASSIESGVPPRFSGSGSGTEFTLTISSLQPDDFATYYCQQYNSYSYTFGQGTKLEIK | 3258 | QQYNSYSYT | KAPPA |
| 6.2M | COV096_6mo_P1_IGG_D1-P1369 | 3259 | EVQLLESGGGLVQPGGSLRLSCAASGFSFSNYAMSWVRQAPGKGLEWVSSISGSGGSPYYADSVKGRFTISRDSSKSTLYLQMNSLSAEDTAVYYCAKSPLVYAPHIFFDCWGQGTLVTVSS | 3260 | AKSPLVYAPHIFFDC | COV096_6mo_P1_Kappa-D1-P1389 | 3261 | EIVLTQSPATLSLSPGERATLSCRTSQSVSSSLAWYQQKPGQAPRLLIYDASNRATAVPARFSGSGSGTDFTLTISSLEPEDFAVYYCQQHSNWLTFGGGTKVEIK | 3262 | QQHSNWLT | KAPPA |
| 6.2M | COV096_6mo_ | 3263 | EVQLVESGGGLVQPGGSLRLSCAASGFTFSNYSMHWVRQAPGKGLEWVSYISSSSSTIYYADS | 3264 | ARQGGGQLSYYY | COV096_6mo_P1_ | 3265 | DIQMTQSPSSLSASVGDRATITCRASQSIGSYLNWYQHKPGKAPKLLIYAASS | 3266 | QQSYST | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | P1_IGG_D5-P1369 | | VKGRFTISRDNAKNSLYLQLNSLRDEDTAVYYCARQGGQQLSYYYYGMDVWGQGTTVTVSS | | YGMDV | Kappa-D5-P1389 | | LQSGVPSGFSGSGSGTDFTLTISSLQPEDFATYYCQQSYSTPGTFGQGTKVEIK | | PGT | |
| 6.2M | COV096_6mo_P1_IGG_D6-P1369 | 3267 | EVQLVESGGALVQPGRSLRLSCAASGFTFDDYAMHWVRQAPGKGLEWVSSISWNGVSIGYADSVRGRFTISRDNAKNSLYLQMNSLKIGDTAFYYCARGLDGSSSASPDSWGQGTLVTVSS | 3268 | ARGLDGSSSASPDS | COV096_6mo_P1_Kappa-D6-P1389 | 3269 | DIQMTQSPSSVSASVGDRVTITCRASQGIGSWLAWYQQKPGKAPKLLIYLASSLQSGVPSRFSGSGSGTYFTLTISGLQPEDFATYYCQQGNSFPLTFGGGTKVEIK | 3270 | QQGNSFPLT | KAPPA |
| 6.2M | COV096_6mo_P1_IGG_E12-P1369 | 3271 | EVQLLESGGGLVQPGGSLRLSCAASGFTFSSYAMSWVRQAPGKGLEWVSAISGSGDGTFYADSVKGRFTISRDNSKNTMYLQMNSLRAEDTAVYYCAKDFGAFIIGDWFDPWGQGTLVTVSS | 3272 | AKDFGAFIIGDWFDP | COV096_6mo_P1_Kappa-E12-P1389 | 3273 | EIVMTQSPATLSVSPGERATLSCRASQTVRSNLAWYQQKPGQAPRLLIYGASTRATGIPARFSGSGSGTEFTLTISSLQSEDFAVYYCQQYNNWPPITFGQGTRLEIK | 3274 | QQYNNWPPIT | KAPPA |
| 6.2M | COV096_6mo_P1_IGG_E5-P1369 | 3275 | EVQLLESGGGLVHPGGSLRLSCAASGFTFSTYAMHWVRQAPGKGLEWVSAISGSGTGTFYADSVKGRFSISRDNSKNTLYLQMNSLRAEDTAVYYCATERIAVSDTRMYNWFDPWGQGTLVTVSS | 3276 | ATERIAVSDTRMYNWFDP | COV096_6mo_P1_Kappa-E5-P1389 | 3277 | DIQMTQSPSSLSASVGDRVTLTCRASQGISTYLNWYQQKPGKAPNLLIYAASSLQSGVPSRFSGSGSGTDFTLTISSLQPEDFATYYCQQSYSAPPWTFGQGTKVEIK | 3278 | QQSYSAPPWT | KAPPA |
| 6.2M | COV096_6mo_P1_IGG_E7-P1369 | 3279 | QLQLQESGPGLVKPSETLSLTCTVSGGAISSRNYHWGWIRQPPGKGLEWIGSIYYSGSTYYSPSLKSRVTISVDTSKNQFSLRLSSVTAADTAVYYCARLETSGWYTEDVFDIWGQGTMVTVSS | 3280 | ARLETSGWYTEDVFDI | COV096_6mo_P1_Kappa-E7-P1389 | 3281 | DIQMTQSPSSLSASVGDRVTITCRASQSISSYLNWYQQKPGKAPKLLIYAASSLQSGVPSRFSGSGSGTDFTLTISSLLPEDFATYYCQRSYSAMYTFGQGTRLEIQ | 3282 | QRSYSAMYT | KAPPA |
| 6.2M | COV096_6mo_P1_IGG_E9-P1369 | 3283 | QVQLVESGGGVVQPGRSLRLSCATSGFTFSNYGMHWVRQAPGKGLEWVAVIWFDGSSEYYADSVKGRFTISRDNSKKTLYLQVNNLRGEDSAVYYCAREGWHYDSSYYREYDDLDIWGQGTMVTVSS | 3284 | AREGWHYDSSYYREYDDLDI | COV096_6mo_P1_Kappa-E9-P1389 | 3285 | DIVMTQTPLSLPVSLGDQASISCRSSQSLVHSDGNTYLHWYLQKPGQSPKLLIYKVSNRFSGVPDRFSGSGSGTDFTLTISRVEAEDLGVYFCSQSTHVPPWTFGGGTRLEIK | 3286 | SQSTHVPPWT | KAPPA |
| 6.2M | COV096_6mo_P1_IGG_F11-P1369 | 3287 | EVQLVESGGGLVQPGGSLRLSCAASGLTVTSNYMSWVRQAPGRGLEWVSLIYPGGTTYYADSVKGRFTVSRDNSKNTLYLQMDSLRAEDTGVYYCARETLGRGGDCWGQGTLVTVSS | 3288 | ARETLGRGGDC | COV096_6mo_P1_Kappa-F11-P1389 | 3289 | DIQMTQSPSSLSASVGDRVTITCQASQDISNFLNWYQQKPGKAPKLLIYDASNLETGVPSRFSGSRSGTDFTFTISDIATYYCQQYDNLPRSFGQGTKLEIK | 3290 | QQYDNLPRS | KAPPA |
| 6.2M | COV096_6mo_P1_IGG_F11-P1369 | 3291 | EVQLVESGGGLVQPGGSLRLSCAASGFTFSTYDMHWVRQTTEKSLEWVSAIGTAGDTYYPDSVKGRFIVSRENAKNSLYLQMNNLRAGDTAVYYCARDRETSGWYGWYFDLWGRGTLVTVS | 3292 | ARDRETSGWYGWYFDL | COV096_6mo_P1_Kappa-F11-P1389 | 3293 | DIQMTQSPSSLSASVGDRVTVTCRASQSIRNFLNWYQQKPGKAPKLLIYTTSTLQSGVPSRFSGSGSGTDFTLTISSLQPEDFATYYCQQSYSTPPITFGQGTRLDMK | 3294 | QQSYSTPPIT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV096_ 6mo_ P1_IGG_ F7- P1369 | 3295 | QVQLVESGGGVVQPGRSLRLSCTASGFTFSTA GMHWVRQAPGKGLEWVAVISYDGSNKDYA DSVKGRFTISRDNSKSTLYLQMNSLRPEDTAV YYCAKDTPGGDDIMTGWGLYGMDVWGQGT TVIASS | 3296 | AKDTPG GDDIMTG WGLYGM DV | COV096_ 6mo_P1_ Kappa- F7- P1389 | 3297 | DIQMTQSPSSLSASVGDRVTITCRASQ SISSYLNWYHQKPGKAPKLLIYAAISL QSGVPSRFSGSGFGTDFTLTISSLQPED FAIYYCQQSYSTPWTFDQGTKVEIK | 3298 | QQS YST PW T | KAPPA |
| 6.2M | COV096_ 6mo_ P1_IGG_ F9- P1369 | 3299 | QVQLVQSGAEVKKPGASVKVSCKASGYTFSD YYIHWVRQAPGQGLEWMGIINPSGGSTAYAQ KFQGRVTMTGDASTSTVYMELNSLRSEDTAV YYCARDIVLVPAAYGMDVWGQGTTVIVSS | 3300 | ARDIVLV PAAYGM DV | COV096_ 6mo_P1_ Kappa- F9- P1389 | 3301 | EIVLTQSPATLSLSPGERATLSCRASQS ISTYLAWYQQKPGQAPRLLIYDASNR ATGIPARFSGSGSGTDFTLTISSLEPED FAVYYCQQRNNWPPLTFGGGTKVEV K | 3302 | QQ RN NW PPL T | KAPPA |
| 6.2M | COV096_ 6mo_ P1_IGG_ G11- P1369 | 3303 | EVQLVESGGGLVQPGGSLRLSCAASGFTFSAY DMHWVRQVTGKGLEWVSAIGTAGDTYYPD DTFDPDSVKGRFTVSRENAKNSLYLQMNSLR AGDTAVYYCVRGDMLTGSSQYYYIMDVWG QGTTVTVSS | 3304 | VRGDML TGSSQYY YIMDV | COV096_ 6mo_P1_ Kappa- G11- P1389 | 3305 | DIQMTQSPSSLSASVGDRVTITCRASQ SISRYLNWYQQKPGKAPKLLIYAASS LQSGVPSRFSGSGSGTDFTLTISSLQPE DFATYSCQQSYSSMYTFGQGTKLEIK | 3306 | QQS YSS MY T | KAPPA |
| 6.2M | COV096_ 6mo_ P1_IGG_ G12- P1369 | 3307 | QVQLVESGGGVVQPGRSLRLSCAASGFTFSSY GMHWVRQAPGKGLEWVALIGYDGTDKYYA ENVKGRFTISRDNSKNTLFLQMNSLRGGDTA VYLCARDGIPFRYGMDVWGQGTTVTVSS | 3308 | ARDGIPF RYGMDV | COV096_ 6mo_P1_ Kappa- G12- P1389 | 3309 | DIQMTQSPSTLSASVGDRVTITCRASQ SIDIWLAWYQQKPGKAPKFLIHKAST LESGVPSRFSGSGSGTEFTLTISSLQPD DFATYYCQHYHSYSGTFGQGTKVEIK | 3310 | QH YHS YSG T | KAPPA |
| 6.2M | COV096_ 6mo_ P1_IGG_ G2- P1369 | 3311 | EVQLVESGGGLVQPGGSLRLSCVASGFSFSDY SMNWVRQAPGKGLEWVSYISSSSSTIYYADS VKGRFTMSRDNAKNSLFLQMNSLRDEDTAV YYCARHWGPQKSYYYYGMDVWGPGTTVTV SS | 3312 | ARHWGP QKSYYY YGMDV | COV096_ 6mo_P1_ Kappa- G2- P1389 | 3313 | DIQMTQSPSSLSASVGDRVTVTCRAS QSINSYLNWYQQKPGKAPKLLIYGAS NLQSGVPSRFSGSESTEFTLTISSLQP EDFATYYCQQSYSTPPAFGQGTKVEI | 3314 | QQS YST PPA | KAPPA |
| 6.2M | COV096_ 6mo_ P1_IGG_ G4- P1369 | 3315 | QVQLVQSGAEVKKPGASVKLSCKASGYSFTS YYILWVRQAPGQGLEWMGIINPSGGATSFAQ KFQGRVTLTRDTSTSTVYMELSSLRSEDTALY YCARDTGDSSGWYPPPILKYNYYYYGMDVW GQGTTVTVSS | 3316 | ARDTGDS SGWYPPP ILKYNYY YYGMDV | COV096_ 6mo_P1_ Kappa- G4- P1389 | 3317 | DIQMTQSPSSLSASVGDRVTITCRASQ GIRNDLGWYQQKPGKAPKRLIYAASS LQSGVPSRFSGSGSGTEFTLTISSLQPE DFATYYCLQHNSYPRTFGQGTKVEIK | 3318 | LQH NSY PRT | KAPPA |
| 6.2M | COV096_ 6mo_ P1_IGG_ H10- P1369 | 3319 | EVQLVESGGGLVQPGRSLRLSCVATGFTFDDF AMHWVRQAPGKGLEWVSGISWNGGIIGYVD SVKGRFTISRDNAKNSLYLQMNSLRPEDTAL YYCVKGYRYYYDILTGYYNDAGAFDYWGQ GTLVTVSS | 3320 | VKGYRY YYDILTG YYNDAG AFDY | COV096_ 6mo_P1_ Kappa- H10- P1389 | 3321 | DIQLTQSPSFLSASVGDRVTITCRASQ GISSYLAWYQQKPGKAPKLLIYPASTL QSGVPSGFSGSGSGTEFTLTISSLQPED FATYYCQQLNDYPFTFGPGTKVDIK | 3322 | QQL ND YPF T | KAPPA |
| 6.2M | COV096_ 6mo_ P1_IGG_ H4- P1369 | 3323 | QLQLQESGPGLVKPSETLSLTCTVSGGSISSRN YHWGWIRQTPGKGLEWIGSIYYSGSTYYNPS LKSRVTISVDTSKNQFSLKMRSVTAADTALYF CARLETSGWYTGDVFDIWGQGTMVTVSS | 3324 | ARLETSG WYTGDV FDI | COV096_ 6mo_P1_ Kappa- H4- P1389 | 3325 | DIQMTQSPSSLSASVGDRVTITCRASQ SISSYLNWYQQKPGKAPKLLIYAAVS LQSGVPSRFSGSGSGTDFTLTINSLQPE DFATYYCQRSYSAMYSFGQGTRLEIQ | 3326 | QRS YSA MY S | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV096_6mo_P1_IGG_H5-P1369 | 3327 | EVQLVESGGRLVQPGRSLRLSCAASGFTFDDYAIHWVRQAPGKGLEWVSGISWNSGSIGYADSVRGRFTISRDNAKNSLYLQMNSLRAEDTALYYCAKGLDSSSSASPDYWGQGTLVTVS | 3328 | AKGLDSSSSASPDY | COV096_6mo_P1_Kappa-H5-P1389 | 3329 | DIQMTQSPSSVSASVGDRVTITCRASQDISSWLAWYQQKPGKAPKLLIYLASSLQSGVPSRFSGSGSGTDFILTISSLQPEDFGTYYCQQGNSFPLTFGGGTKVEIK | 3330 | QQGNSFPLT | KAPPA |
| 6.2M | COV096_6mo_P1_IGG_H6-P1369 | 3331 | QVQLVESGGGVVQPGRSLRLSCAASGFTFSSYSIHWVRQAPGKGLEWVAVISDDASMKFYADSVKGRFTISRDNSKNTLFLQMNSLSPEDTAVYYCARDALTAISVRFDYWGQGTLVTVSS | 3332 | ARDALTAISVRFDY | COV096_6mo_P1_Kappa-H6-P1389 | 3333 | DIQMTQSPSSLSASVGDRVTITCRASQSISRYLNWYQQKPGKAPKLLIYDASSFQSGVPSRFSGSGSGTDFTLTISSLQPEDFATYYCQQSYSTPSVTFGGGTKVEIK | 3334 | QQSYSTPSVT | KAPPA |
| 6.2M | COV096_6mo_P2_IGG_H8-P1369 | 3335 | QVQLVQSGAEVKKPGASVKVSCKASGYTFTSFYMHWVRQAPGQGLEWMGIINPSGGATTYAQKFQGRVTMTSDASTSTLYMELSSLRSDDTAVYYCTRDAGFIPTDNWFDPWGQGTLVTVS | 3336 | TRDAGFIPTDNWFDP | COV096_6mo_P2_Kappa-H8-P1389 | 3337 | EIVLTQSPGTLSLSPGERATLSCRASQSVSSSYLAWYQQKPGQAPRLLIYGASSRATGIPDRFSGSGSGTDFTLTISRLEPEDFAVYYCQQYGRSALGMCSFGQGTKLEIK | 3338 | QQYGRSALGMCS | KAPPA |
| 6.2M | COV096_6mo_P2_IGG_A10-P1369 | 3339 | QVQLVESGGGVVQPGRSLRLSCAASGFTFSSYDMHWVRQAPGKGLEWVVISXDGSSKFYADSVKGRFTISRDNSKNTLYLQMNSLRAEDTAVYYCARDPPGEISTTPVLDYWGQGTLVTVS | 3340 | ARDPPGEISTTPVLDY | COV096_6mo_P2_Kappa-A10-P1389 | 3341 | DIQMTQSPSSLAASVGDRVTITCRASQSISNYLNWYQQKPGKAPNLLIYAASSLQSGVPSRFSGSGSGTDFTLTISSLQPEDFATYYCQQSYSTPPLTFGGGTKVEIK | 3342 | QQSPPLT | KAPPA |
| 6.2M | COV096_6mo_P2_IGG_A1-P1369 | 3343 | EVQLVESGGGLVKPGGSLRLSCAASGFTFSNAWMSWVRQAPGKGLEWVGHIKSKTDGGTTDYATPVKGRFTISRDDSKNTLYLQMNSLKSEDTAVYFCSTSDLIYYYSYGMDVWGQGTTVTVSS | 3344 | STSDLIYYYSYGMDV | COV096_6mo_P2_Kappa-A1-P1389 | 3345 | DIQMTQSPSTLSASVGDRVTITCRASQSISSWLAWYQQKPGKAPKLLIYKASTLQSGVPSRFSGSGSGTEFTLTISSLQPDDFATYYCQQYNSYSSYTFGQGTKLEIK | 3346 | QQYNSYSSYT | KAPPA |
| 6.2M | COV096_6mo_P2_IGG_A5-P1369 | 3347 | QVQLVQSGAEVKKPGSSVRVSCKASGGTFSRNVISWVRQAPGQGLEWMGGIIPMFATANYAQKFQGRVTITADESSSTAYMELSSLRSEDTAVYYCAREDFILVSAPIRENSYYYYGMDVWGQGTTVTVSS | 3348 | AREDFILVSAPIRENSYYYYGMDV | COV096_6mo_P2_Kappa-A5-P1389 | 3349 | EIVLTQSPGTLSLSPGERATLSCRASQSVSSNYLAWYQQKPGQAPRLLIYDASSRATGIPDRFSGSGSGTDFTLTISRLEPEDFAVYYCQQYGGSPRTFGQGTKVEIK | 3350 | QQYGGSPRT | KAPPA |
| 6.2M | COV096_6mo_P2_IGG_B8-P1369 | 3351 | EVQLVESGGGLVKPGGSLRLSCAASGFPFTNAWMSWVRQAPGKGLEWVGHIKDYTDGGTTDYAAPVKGRFTISRDDSKNTLYLHMNSLK1EDTAVYYCSTVGSYYYDSRGPTSDAFDIWGQGTMVTVSS | 3352 | STVGSYYYDSRGPTSDAFDI | COV096_6mo_P2_Kappa-B8-P1389 | 3353 | DIVMTQSPDSLAMSLGERATINCKSSQSVLYSSNKKNYLAWYRQKPGQPPKLLIYWASTRESGVPDRFSGSGSGTDFTLTISSLQAEDVAVYYCQQYYSTPYTFGQGTKLEIK | 3354 | QQYYSTPYT | KAPPA |
| 6.2M | COV096_6mo_P2_IGG_C10-P1369 | 3355 | QVQLVQSGAEVKKPGSSVKVSCKASGGTFNSYAISWVRQAPGQGLEWMGGIIPIFGTANYAQKFQGRVTITADESTGMAYMELSSLRSEDTAVYYCARVGAPMSRVRGYYYYYGMDVWGPGTTVTVSS | 3356 | ARVGAPMSRVRGYYYYYGMDV | COV096_6mo_P2_Kappa-C10-P1389 | 3357 | DIVMTQSPLSLPVTPGEPASISCRSSQSLLQSNGNSFLDWYLQKPGQSPQLLIYLGSNRASGVPDRFSGSGSGTDFTLKISRVEAEDVGVYYCMQALQRCSFGQGTKLEIK | 3358 | MQALQRCS | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV096_6mo_P2_IGG_C12-P1369 | 3359 | EVQLLESGGGLVQPGGSLRLSCAASGFTFSSYAMNWVRQAPGKGLEWVSAISGSGGGTYYADSVKGRFTISRDNSKNTLYLQMDSLRAEDTAVYYCAKDVPIEQQLVPTFDYWGQGALVTVSS | 3360 | AKDVPIEQQLVPTFDY | COV096_6mo_P2_Kappa-C12-P1389 | 3361 | DIQMTQSPSSLSASVGDRVTITCRASQSISRYLNWYQQKPGKAPKLLIYGASSLQSGVPSRFSGSGSGTDFTLTISSLQPEDFATYWCQQSYSTLSITFGQGTRLEIK | 3362 | QQSYSTLSIT | KAPPA |
| 6.2M | COV096_6mo_P2_IGG_C1-P1369 | 3363 | EVQLLESGGGLVQPGGSLRLSCAASGFTFNNYAMNWVRQAPGRGLEWVSGISGSGANTYYADSVKGRFTISRDNPKNTLSLQMNSLRAEDTALYYCAKVLSPTYYDSWSGPDAFDFWGQGTMVTVTS | 3364 | AKVLSPTYYDSWSGPDAFDF | COV096_6mo_P2_Kappa-C1-P1389 | 3365 | DIQMTQSPSTLSASVGDRVTITCRASQTISPWLAWYQQKPGKAPNLLIYKASSLESGVPSRFSGSGSGTEFTLTISSLQPDDFATYYCQQYNSYSSWTFGQGTKVEIK | 3366 | QQYNSYSSWT | KAPPA |
| 6.2M | COV096_6mo_P2_IGG_D10-P1369 | 3367 | QVQLQESGPGLVKSSETLSLSCTVSGGSISSHYWSWIRQPAGKALEWIGRLYTSGSTAYNPSLKSRVTMSVDTSKNQFSLKLTSVTAADTAVYYCAREPNYHYHGMDVWGQGTTVTVS | 3368 | AREPNYHYHGMDV | COV096_6mo_P2_Kappa-D10-P1389 | 3369 | DIQMTQSPSSVSASVGDRVTITCRASQGISSWLAWYQQKPGKAPKLLIYAASSLQSGVPSRFSGSGSGTDFTLTISSLQPEDFATYYCQQGNSFLLTFGGGTKVEIK | 3370 | QQGNSFLLT | KAPPA |
| 6.2M | COV096_6mo_P2_IGG_D2-P1369 | 3371 | QVQLVQSGAEVKKPGASVKVSCKASGYTFTDSYMHWVRQAPGQGLEWMGIINPSGGSTTYAQKFQGRVTMTRDTSTSKVYMELSSLRSEDTAVYYCARDAFYIPAGGWFDPWGQGTLVTVS | 3372 | ARDAFYIPAGGWFDP | COV096_6mo_P2_Kappa-D2-P1389 | 3373 | EIVLTQSPGTLSLSPGERATLSCRASQSVSSSYFAWYQQKPGQAPRLLIYGASSRATGIPDRFSGSGSGTDFTLTISRLEPEDVAVYYCQQYGSSSRTFGQGTKVEIK | 3374 | QQYGSSSRT | KAPPA |
| 6.2M | COV096_6mo_P2_IGG_D4-P1369 | 3375 | QVQLVQSGAEVKKPGASVKVSCKASGYTFSDHYIYWVRQAPGQGLEWMGIINPSAGSTSYAQKFQGRVTMTRDTSTSTVYMELSSLRSEDTAVYYCARDIVFVPATMAMDVWGLGTTVTVSS | 3376 | ARDIVFVPATMAMDV | COV096_6mo_P2_Kappa-D4-P1389 | 3377 | EIVLTQSPATLSLSPGERATLSCRASQSVSRYLAWYQQKPGQAPRLLIYDASNRATGIPARFSGSGSGTDFTLTISSLEPEDFAVYYCQQRSNWLFTFGPGTKVDIK | 3378 | QQRSNWLFT | KAPPA |
| 6.2M | COV096_6mo_P2_IGG_D5-P1369 | 3379 | QVQLVQSGAEVKKPGSSVKVSCKASGDTSSSYGINWVRQAPGQGLEWMGEIIPMFETTNYAQKFQGRVTITADESTSTAYMELSSLRSEDTAVYYCARDPGYGNHDLDFWGQGTLVTVSS | 3380 | ARDPGYGNHDLDF | COV096_6mo_P2_Kappa-D5-P1389 | 3381 | DIQMTQSPSSLSASVGDRVTITCRASQGISSWLAWYQQKPGKAPKLLIYSASSLQSGVPSRFSGSGSGTNFTLTISSLQPEDFATYYCQQARTFGPGTKVDIK | 3382 | QQART | KAPPA |
| 6.2M | COV096_6mo_P2_IGG_D6-P1369 | 3383 | EVQLVESGGGLVQPGGSLRLSCTASGFIVSSNYMSWVRQAPGKGLEWVSVLYSGGSTFYADSVKGRFTISRDNSKNTLYLQMNSLRSDDTAVYYCARDLRGPGKFDYWGQGTLVSVSS | 3384 | ARDLRGPGKFDY | COV096_6mo_P2_Kappa-D6-P1389 | 3385 | DIQMTQSPSSLSASVGDRVTITCQASQGISNSLNWYQQKPGKAPKLLIYDASNLETGVPSRFSGSGSGTDFTFTISSLQPEDIATYYCQQYDNLPEVTFGQGTRLEIK | 3386 | QQYDNLPEVT | KAPPA |
| 6.2M | COV096_6mo_P2_IGG_D7-P1369 | 3387 | QVQLQESGPGLVKPSETLSLTCSVSGGSIFTHCWSWIRQPPGKGLEWIGNIYFSGKTNYNASLKSRVTISVDTSKNQFSLKLSSVTTADTAVYYCARALTYNDILTGGEYFNGMDVWGQGTTVTVSS | 3388 | ARALTYNDILTGGEYFNGMDV | COV096_6mo_P2_Kappa-D7-P1389 | 3389 | DIQMTQSPSSLSASVGDRVTITCRASQDIRNDLGWYHQKPGKAPRRLIYAASSLQSGVPSRFSGSGSGTEFTLTISSLQPEDFATYYCLQHNSYPWTFGQGTKVEIK | 3390 | LQHNSYPWT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV096_6mo_P2_IGG_E10-P1369 | 3391 | EVQLVESGGGLIQPGGSLRLSCAASGVIVRSNYMSWVRQAPGKGLEWVALIYSGGTTDYADSVKGRFTISRDNSKNTLYLQMDSLRAEDTAVYYCARDLIVYGMDVWGQGTTVTVSS | 3392 | ARDLIVYGMDV | COV096_6mo_P2_Kappa-E10-P1389 | 3393 | DIQLTQSPSFLSASVGDRVTITCRASQGISSFLAWYQQKPGKAPKLLIYGASTLQSGVPSRFSGSGSGTEFTLTISSLQPEDFATYYCQQLNSYPMCSFGQGTKLEIK | 3394 | QQLNSYPMCS | KAPPA |
| 6.2M | COV096_6mo_P2_IGG_E2-P1369 | 3395 | QVQLVQSGAEVKKPGASVKVSCKASGYPFSRYYIHWVRQAPGQGLEWMGIINPSGGSTTYAQRFQGRVTMTRDTSASTVYLDLSSLGSEDSAVYYCARPLLPGETGNLNRLDYWGQGTLVTVSS | 3396 | ARPLLPGETGNLNRLDY | COV096_6mo_P2_Kappa-E2-P1389 | 3397 | DIQMTQSPSSLSASVGDRVTITCRASQSISSYLNWYQQKPGIAPXLLIYGASQSGVPSRFSGSGSGTDFTLTISSVQPDDFATYYCQQSYSTLWTFGQGTKVEIK | 3398 | QQSYSTLWT | KAPPA |
| 6.2M | COV096_6mo_P2_IGG_E5-P1369 | 3399 | EVQLVESGGGLVQPGGSLRLSCAASGIIVSSNYMNWVRQVPGKGLEWVSVLYSGGSTFYADSVRGRFTISRDNSKNTLFLQMNSLRPEDTAVYYCARDFREGAFDIWGQGTMVTV | 3400 | ARDFREGAFDI | COV096_6mo_P2_Kappa-E5-P1389 | 3401 | DIQLTQSPSFLSASVGDRVTITCRASQGISSYLAWYQQKPGKAPNLLIYAASTLQSGVPSRFSGSGSGTDFTLTISSLQPEDFATYYCQQLNSYSPLFGQGTRLEIK | 3402 | QQLNSYSPL | KAPPA |
| 6.2M | COV096_6mo_P2_IGG_E8-P1369 | 3403 | QVQLQESGPGLVKPSQTLSLTCTVSGGSISSGGYYWSWIRQHPGKGLEWIGYIYYSGSGSTYYNPSLKSRVIISVDTSKNHFSLKLNSVTAADTAVYYCARDRPNYYFDSRDAFDIWGQGTMVTVSS | 3404 | ARDRPNYYFDSRDAFDI | COV096_6mo_P2_Kappa-E8-P1389 | 3405 | DIVMTQSPDSLAVSLGERATINCKSGQSLLYSSNNKNYLAWYQQKPGQPPKLLIYWASTRESGVPDQFSGSGSGTDFTLTISSLQAEDVAVYYCQQTPRYYSTPRTFGQGTKVEIK | 3406 | QQYYSTPRT | KAPPA |
| 6.2M | COV096_6mo_P2_IGG_F10-P1369 | 3407 | EVQLVESGGGLVQPGRSLRLSCAASGFTFDDYALHWVRQAPGKGLEWVSGISWNGDSIGYADSVKGRFTISRDNAKNSLSLQMNSLTAEDTAFYYCARGVEYSSSSNCDFWGQGTLVTVSS | 3408 | ARGVEYSSSSNCDF | COV096_6mo_P2_Kappa-F10-P1389 | 3409 | DIQMTQSPSSVSASVGDRVTITCRASQGISSWLAWYQQKPGKAPKLLIYAASSLQSGVPSRFSGSGSETDFTLTISSLQPEDFATYYCQQTNSFPLTFGGGTKVEI | 3410 | QQTNSFPLT | KAPPA |
| 6.2M | COV096_6mo_P2_IGG_F12-P1369 | 3411 | EVQLVESGGGLAQPGRSLRLSCAASGFMFDDYTMHWVRQAPGKGLEWVSGISWNSENIGYADSVKGRFTISRDNAKNSLFLQINSLRADDTAFYYCVREEVGGWFDPWGQGTLVAVSS | 3412 | VREEVGGWFDP | COV096_6mo_P2_Kappa-F12-P1389 | 3413 | DIVMTQTPLSLPVSLGDQASISCRSSQSLVHSDGNTYLHWYLQKPGQSPKLLIYKVSNRFSGVPDRFSGSGSGTDFTLTISRVEAEDLGVYFCSQSTHVPPWTFGGGTRLEIK | 3414 | SQSTHVPPWT | KAPPA |
| 6.2M | COV096_6mo_P2_IGG_F1-P1369 | 3415 | QVQLVESGGGVVQPGRSLRLSCAASGFTFSSYGMHWVRQAPGKGLEWVAVIWYDGSYKHYADSVKGRFAISRDNSKNTLHLQMNSLRAEDTAVYYCARDSNVDTVMVTWFDYWGQGTLVTVSS | 3416 | ARDSNVDTVMVTWFDY | COV096_6mo_P2_Kappa-F1-P1389 | 3417 | DIQMTQSPSSLSASVGDRVTITCRASQSISSYLNWYQQKPGKAPKLLIYVASSLQSGVPSRFSGSGSGTDFTLTISSLQPEDFATYYCQQSYSTPPWTFGQGTKVEI | 3418 | QQSYSTPPWT | KAPPA |
| 6.2M | COV096_6mo_P2_IGG_F2-P1369 | 3419 | EVQLVESGGGLVQPGGSLRLSCAASGFTFSSDDMHWVRQATGKGLEWVSAIGTSGDTYYSGSVKGRFTISRENAKNSFYLQMNSLRAGDTAVYYCARGVITSLDGNYYYYMDVWGQGTTVTVSS | 3420 | ARGVITSLDGNYYYYMDV | COV096_6mo_P2_Kappa-F2-P1389 | 3421 | DIQMTQSPSSLSASVGDRVTITCRASQNIRFYLNWYQQKPGKAPNLLIYAASNLQSGVPSRFSGGGSGTDFTLTISSLQPEDFATYYCQQSYSSPPWTFGPGTKVEIK | 3422 | QQSYSSPPWT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV096_6mo_P2_IGG_F3-P1369 | 3423 | QVQLVQSGAELKKPGSSLKVSCKASGGTFSSSAISWVRQAPGQGLEWMGGIIPSLTTANYAQRFQDKVTITADISTSTVYMELSSLRSEDTAIYYCAKGPRLHDSLWGSFRFDAFDIWGQGTMVTVSS | 3424 | AKGPRLHDSLWGSFRFDAFDI | COV096_6mo_P2_Kappa-F3-P1389 | 3425 | DIVMTQTPLSLPVTPGEPASISCRSSQSLLDSDYGNTYLDWYLQKPGQSPQLLIYTLSYRASGVPDRFSGSGSGTDFTLKISRVEAEDVGVYYCMQRMDFPYSFGQK | 3426 | MQRMDFPYS | KAPPA |
| 6.2M | COV096_6mo_P2_IGG_F7-P1369 | 3427 | EVQLVESGGGLVKPGGSLRLSCAASGFPFTNAWMSWVRQAPGKGLEWVGHIKDYTDGGTTDYAAPVKGKFTISRDDSKNTLYLHMNSLK1EDTAVYYCSTVGSYYYDSRGPTSDAFDIWGQGTMVTVSS | 3428 | STVGSYYYDSRGPTSDAFDI | COV096_6mo_P2_Kappa-F7-P1389 | 3429 | DIVMTQSPDSLAVSLGERATINCKSSQSVLYSSNKKNYLAWYRQKPGQPPKLLIYWASTRESGVPDRFSGSGSGTDFTLTISSLQAEDVAVYYCQQYYSTPYTFGQGTKLEIK | 3430 | QQYYSTPYT | KAPPA |
| 6.2M | COV096_6mo_P2_IGG_F9-P1369 | 3431 | QVQLVESGGGMVQPGRSLRLSCAASGFTFNNYAMHWVRQALGKGPEWVAAISSDGRTKTYTDSVKGRFTISRDNSENTLYLQMNSVRAEDTALYYCAKDSVGIVDYFDYWGQGTLVTVSS | 3432 | AKDSVGIVDYFDY | COV096_6mo_P2_Kappa-F9-P1389 | 3433 | DIQMTQSPSSLSASVGDRVTITCRASQIISNYLNWYQQKPGKAPKLLIFAASSLQSGVPSRFSASGSGTDFTLTISSLQPEDFATYYCQQSYSTPPYTFGQGTKLEIK | 3434 | QQSYSTPPYT | KAPPA |
| 6.2M | COV096_6mo_P2_IGG_G11-P1369 | 3435 | EVQLVQSGAEVKKPGESLKISCKGSGYRFTNYWIGWVRQMPGKGLEWIGNIFPGDSDSRYSPSFQGQVTISVDMSITTAYLHWSSLKASDTAIYYCARLSERWYSPFDSWGQGTLVTVSS | 3436 | ARLSERWYSPFDS | COV096_6mo_P2_Kappa-G11-P1389 | 3437 | EIVMTQSPATLSVSPGERATLSCRASQSNLAWYQQKPGQAPRLLIYGASTRATGFPARFSGSGSGTEFTLTISSLQSEDFAVYFCQQYNNWPPGGFTFGPGTKVDIK | 3438 | QQYNNWPPGGFT | KAPPA |
| 6.2M | COV096_6mo_P2_IGG_G1-P1369 | 3439 | EVQLVESGGGLVKPGGSLRLSCAASGLTFSHAWMSWVRQAPGKGLEWVGRIKSKIDGGTTDYAAPVKGRFTISRDDSKSTQYLQMNSLKTEDTAVYYCTTDCFWRLRGTSCYEHDAFDIWGQGTMVTVSS | 3440 | TTDCFWRLRGTSCYEHDAFDI | COV096_6mo_P2_Kappa-G1-P1389 | 3441 | DIQMTQSPSSLSASVGDRVTITCRASQTIASFLNWYQQKPGKAPKLLIYAASSLQSGVPSRFSGSGSGTDFTLTISSLQPEDFATYYCQQSYNSLHFGGGTQVEIK | 3442 | QQSYNSLH | KAPPA |
| 6.2M | COV096_6mo_P2_IGG_G2-P1369 | 3443 | EVQLVQSGAEVKKPGESLKISCKVSGYTFTNYWIGWVRQMPGKGLEWMGIIFPGDSDTRYSPSFQGQVTISADRSITTAYLQWRSLKASDTAMYYCARVPSSSDYGDYGGFEYWGQGTLVTVSS | 3444 | ARVPSSSDYGDYGGFEY | COV096_6mo_P2_Kappa-G2-P1389 | 3445 | DIQMTQSPSSLSASVGDRVTITCRASQTITIYLNWYQQKPGKAPKLLIYAASSLQSGVPSRFSGSGSGTDFTLTISSLQPEDFATYYCQQSYSTPCSFGQGTKLEIK | 3446 | QQSYSTPCS | KAPPA |
| 6.2M | COV096_6mo_P2_IGG_G4-P1369 | 3447 | QVQLVESGGGVVQPGKSLRLSCAASGFTFRSYAMHWVRQAPGKGLEWVAVIWDDGSSKHYSDSVKGHFTISRDNSKNTLYLQMNSLRAEDTAVYYCARDSNVDTVMVTWFDYWGQGTLVTVSS | 3448 | ARDSNVDTVMVTWFDY | COV096_6mo_P2_Kappa-G4-P1389 | 3449 | DIQMTQSPSSLSASVGDRVTITCRASQSISNYLNWYQQKPGKAPNLLIYTASSLQSGVPSRFSGSGSGTDFTLTISSLQPEDFATYYCQQSYSTPPWTFGQGTKVEIK | 3450 | QQSYSTPPWT | KAPPA |
| 6.2M | COV096_6mo_P2_IGG_G9-P1369 | 3451 | QVQLQQWGAGLLKPSATLSLTCAVYGASFSGYSWSWIRQPPGRGLEWVGEINHSGGTNYNPSLKSRVTISADTSKNQFSLKLSSVTAADTAVYYCATTRSELRYFGYNYYGVDVWGQGTAVSVSS | 3452 | ATTRSELRYFGYNYYGVDV | COV096_6mo_P2_Kappa-G9-P1389 | 3453 | DIQMTQSPSSLSASVEDRVTITCRASQGIRNDLGWYQQKPGKAPKRLIYAASSLQSGVPSRFSGSGSGTEFTLTISSLQPEDSATYYCLQYNTYPRTFGQGTKVEIK | 3454 | LQYNTYPRT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 6.2M | COV096_6mo_P2_IGG_H11-P1369 | 3455 | QVQLVESGGGVVLPGRSLRLSCAASGLTFGMHWVRQAPGKGLEWVAVISNDGSNKYYADSVKGRFTISRDNSKNTLYLQMNSLRAEDTALYYCAKDFFMYYSGWYRYYIDYWGQGTLVTVSS | 3456 | AKDFFMYYSGWYRYYIDY | COV096_6mo_P2_Kappa-H11-P1389 | 3457 | DIQMTQSPSSLSASLGDRVTITCQASQDISNFLNWYQQKPGRAPKLLIYDASNLETGVPSRFSGSGSGTDFTFTISSLQPEDIATYYCQQYDNLPLTFGGGTKVEIK | 3458 | QQYDNLPLT | KAPPA |
| 6.2M | COV096_6mo_P2_IGG_H4-P1369 | 3459 | EVQLVESGGGLIQRGGSLRLSCAASGLTVSSNYMTWVRQAPGTGLEWVSVIYSGGSTFYADSVKGRFTISRDNSKNTLYLQMNSLRPEDTAVYYCARDRGESGLDVWGQGTTVTVSS | 3460 | ARDRGESGLDV | COV096_6mo_P2_Kappa-H4-P1389 | 3461 | DIQMTQSPSFVSASVGDRVTITCRASQGISRWLAWYQQKPGKAPKLLIYAASSLQSGVPSRFSGSGSGTDFTLTISSLQPEDFATYYCQQANSFPLFGGGTKVEIK | 3462 | QQANSFPL | KAPPA |
| 6.2M | COV096_6mo_P2_IGG_H8-P1369 | 3463 | QVQLVQSGAEVKKPGASVKVSCKASGYTFTGSYMHWVRQAPGQGLEWMGWINPNSGGTNYAQKFQGRVTMTRDTSISTAYMELSSLRSDDTAVYFCARFGSGWQWLGKTDVWGQGTTVTVSS | 3464 | ARFGSGWQWLGKTDV | COV096_6mo_P2_Kappa-H8-P1389 | 3465 | DIQMTQSPSSLSASVGDRVTITCQASQDISTYLNWYQQKPGKAPKLLIYDASNLETGVPSRFSGSGSGTDFTFTISSLQPEDIATYYCQQYDNLPQYTFGQGTKLEIK | 3466 | QQYDNLPQYT | KAPPA |
| 6.2M | COV096_6mo_P2_IGG_H9-P1369 | 3467 | EVQLVESGGGLVQPGRSLRLSCAASGFTFDDYALHWVRQAPGKGLEWVSGISWNGDSIGYADSVKGRFTISRDNAKNSLSLQMNSLTAEDTALYYCAKGVEYSSSSNCDYWGQGTLVTVSS | 3468 | AKGVEYSSSSNCDY | COV096_6mo_P2_Kappa-H9-P1389 | 3469 | DIQMTQSPSSVSASVGDRVTITCRASQDISSWLAWYQQKPGKAPKLLISLASGLQSGVPSRFSGSGSETDFTLTISSLQPEDFATYYCQQTNSFPLTFGGGTKVEI | 3470 | QQTNSFPLT | KAPPA |
| 1.3M | COV096_HC_100-P1369 | 3471 | EVQLLESGGGLEQPGGSLRLSCAASGFTFSTYAMSWVRQAPGKGLEWVSAISGSGAGTFYADSVKGRFTISRDNSKNTLYLQMNSLRAEDTAVYYCARESDCGSTSCYQVGWFDPWGQGTLVTVSS | 3472 | ARESDCGSTSCYQVGWFDP | COV096_KC_100-P1389 | 3473 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK | 3474 | QQSYSTPPWT | KAPPA |
| 1.3M | COV096_HC_106-P1369 | 3475 | EVQLVESGGGLVQPGRSLRLSCAASGFTFDDYAMHWVRQAPGKGLEWVSGISWNSDSIGYADSVKGRFTISRDNAKNSLYLQMNSLTAEDTALYYCAKGVEYSSSSNFDYWGQGTLVTVSS | 3476 | AKGVEYSSSSNFDY | COV096_KC_106-P1389 | 3477 | DIQMTQSPSSVSASVGDRVTITCRASQGISSWLAWYQQKPGKAPKLLIYTASGLQSGVPSRFSGSGSETDFTLTISSLQPEDFATYYCQQTNSFPLTFGGGTKVEI | 3478 | QQTNSFPLT | KAPPA |
| 1.3M | COV096_HC_113-P1369 | 3479 | QVQLVQSGAEVKKPGASVKVSCKASGHTFTSYYMHWVRQAPGQGLEWMGIINPSGGSTSYAQKFQGRVTMTRDTSTSTVYMELSSLRSEDTAVYYCARGPERGIVGATDYFDYWGQGTLVTVSS | 3480 | ARGPERGIVGATDYFDY | COV096_KC_113-P1389 | 3481 | EIVLTQSPGTLSLSPGERATLSCRASQSVSSSYLAWYQQKPGQAPRLLIYGASSRATGIPDRFSGSGSGTDFTLTISRLEPEDFAVYYCQQYVSSPWTFGQGTKVEIK | 3482 | QQYVSSPWT | KAPPA |
| 1.3M | COV096_HC_115-P1369 | 3483 | EVQLVESGGGLVQPGGSLRLSCAASGFTVSSNYMSWVRQAPGKGLEWVSLIYSGGSTYYADVKGRFTISRDNSKNTLYLQMNSLRAEDTAVYYCARDTLGRGGDYWGQGTLVTVSS | 3484 | ARDTLGRGGDY | COV096_KC_115-P1389 | 3485 | DIQMTQSPSSLSASVGDRVTITCQASQDISNYLNWYQQKPGKAPKLLIYDASNLETGVPSRFSGSGSGTDFTFTISSLQPEDIATYYCQQYDNLPRSFGQGTKLEIK | 3486 | QQYDNLPRS | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV096_HC_122-P1369 | 3487 | QVQLVESGGGVVQPGRSLRLSCAASGFTFSNYGMHWVRQAPGKGLEWVAVIWYDGSNKHYADSVKGRFTISRDNSKNTLYLQMNSLRAEDTAEYYCARDMGTLVTHFDYWGQGTLVTVSS | 3488 | ARDMGTLVTHFDY | COV096_KC_122-P1389 | 3489 | DIQMTQSPSSLSASVGDRVTITCRASQSISSYLNWYQQKPGKAPKLLIYAASNLQSGVPSRFSGSGSGTDFTLTISSLQPEDFATYYCQQSYSSPPWTFGQGTKVEIK | 3490 | QQSYSSPPWT | KAPPA |
| 1.3M | COV096_HC_123-P1369 | 3491 | EVQLVESGGGLVQPGGSLRLSCAASGFIFSSYDMHWVRQATGKGLEWVSTIGTAGDTYYPDSVKGRFTISRENAKNSLYLQMNSLRAGDTAVYYCARGDYNILTGYYFDYWGQGTLVTVSS | 3492 | ARGDYNILTGYYFDY | COV096_KC_123-P1389 | 3493 | DIQMTQSPSSLSASVGDRVTITCRASQSISSYLNWYQQKPGKAPNLLIYAASQSGVPSRFSGSGSGTDFTLTISSLQPEDFATYYCQQSYNTPQVTFGGGTKVESK | 3494 | QQSYNTPQVT | KAPPA |
| 1.3M | COV096_HC_124-P1369 | 3495 | EVQLVQSGAEVKKPGESLKISCKVSGYTFTNYWIGWVRQMPGKGLEWMGIIYPGDSDTRYSPSFQGQVTISADKSIITAYLQWSSLKASDTAMYYCARVPSSSDYGDYGGFEYWGQGTLVTVSS | 3496 | ARVPSSSDYGDYGGFEY | COV096_KC_124-P1389 | 3497 | DIQMTQSPSSLSASVGDRVTITCRASQSISSYLNWYQQKPGKAPKLLIYAASQSGVPSRFSGSGSGTDFTLTISSLQPEDFATYYCQQSYSTPCSFGQGTKLEIK | 3498 | QQSYSTPCS | KAPPA |
| 1.3M | COV096_HC_126-P1369 | 3499 | EVQLVESGGGLVQPGGSLRLSCAASGFNFSTHWMHWVRQAPGKGLVWVSRINSDGSRRAYATSVKGRFTISRDNAKNTLYLQMDSLRDEDTAVYYCTRDDSSWPHFFDNWGQGTLVTVSS | 3500 | TRDDSSWPHFFDN | COV096_KC_126-P1389 | 3501 | DIQMTQSPSSLSASVGDRVTIPCRASQNIDNYLNWYQQKPGKAPKLLIFAASGLQDEAPSRFSGVGSGTDFTLTISSLQPEDSATYYCQQSYISPYTFGRGTKLEIK | 3502 | QQSYISPYT | KAPPA |
| 1.3M | COV096_HC_127-P1369 | 3503 | QVQLVQSGAEVKKPGASVKVSCKASGYTFTYYYMHWVRQAPGQGLEWMGIINPSGGSTSYAQKFQGRVTMTRDTSTSTVYMELSSLRSEDTAVYYCARPLLPGETGSLNRLDYWGQGTLVTVSS | 3504 | ARPLLPGETGSLNRLDY | COV096_KC_127-P1389 | 3505 | DIQMTQSPSSLSASVGDRVTITCRASQSISSYLNWYQQKPGKAPKLLIYAASSLQSGVPSRFSGSGSGTDFTLTISSLQPEDFATYYCQQSYSTLWTFGQGTKVEIK | 3506 | QQSYSTLWT | KAPPA |
| 1.3M | COV096_HC_12-P1369 | 3507 | EVQLVQSGAEVKKPGESLKISCKGSGYRFTNYWIGWVRQMPGKGLEWMGIIYPGDSDTRYSPSFQGQVTISADKSITTAYLQWSSLKASDTAMYYCARLSDRWYSPFDPWGQGTLVTVSS | 3508 | ARLSDRWYSPFDP | COV096_KC_12-P1389 | 3509 | EIVMTQSPATLSVSPGERATLSCRASQSVSSNLAWYQQKPGQAPRLLIYGASTRATGIPARFSGSGSGTEFTLTISSLQSEDFAVYYCQQYNNWPPGGFTFGPGTKVDIK | 3510 | QQYNNWPPGGFT | KAPPA |
| 1.3M | COV096_HC_132-P1369 | 3511 | EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCVKGVEYSSSSNFDYWGQGTLVTVSS | 3512 | VKGVEYSSSSNFDY | COV096_KC_132-P1389 | 3513 | DIQMTQSPSSVSASVGDRVTITCRASQGISSWLAWYQQKPGKAPKLLIYTASGLQSGVPSRFSGSGSETDFTLTISSLQPEDFATYYCQQTNSFPLTFGGGTKVEI | 3514 | QQTNSFPLT | KAPPA |
| 1.3M | COV096_HC_133-P1369 | 3515 | EVQLVESGGGLVQPGGSLRLSCAASGFTVSSNYMSWVRQAPGKGLEWVSLIYSGGSTYYADSVKGRFTISRDNSKNTLYLQMNSLRAEDTAVYYCARDTFGRGGDYWGQGTLVTVSS | 3516 | ARDTFGRGGDY | COV096_KC_133-P1389 | 3517 | DIQMTQSPSSLSASVGDRVTITCQASQDISNYLNWYQQKPGKAPKLLIYDASNLETGVPSRFSGSGSGTDFTFTISSLQPEDIATYYCQQYDNLPRSFGQGTKLEIK | 3518 | QQYDNLPRS | KAPPA |
| 1.3M | COV096_HC_134-P1369 | 3519 | EVQLVESGGGLIQPGGSLRLSCAASGFTVSSNYMSWVRQAPGKGLEWVSVIYSGGSTFYADSVKGRFTFSRDNSKNTLYLQMNSLRAEDTAVYYCARDLMAYGMDVWGQGTTVTVSS | 3520 | ARDLMAYGMDV | COV096_KC_134-P1389 | 3521 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPQGTFGGGTKVEIK | 3522 | QQLNSYPQGT | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV096_HC_137-P1369 | 3523 | EVQLVESGGGLVQPGGSLRLSCAASGFTFSDMHWVRQATGKGLEWVSAIGTAGDTYYPGSVKGRFTISRENAKNSLYLQMNSLRAGDTAVYYCARGDSGSYLGVWYFDLWGRGTLVTVSS | 3524 | ARGDSGSYLGVWYFDL | COV096_KC_137-P1389 | 3525 | DIQMTQSPSSLSASVGDRVTITCRASQSISSYLNWYQQKPGKAPKLLIYAASSLQSGVPSRFSGSGSGTDFTLTISSLQPEDFATYYCQQSYSSPPITFGPGTKVDIK | 3526 | QQSYSSPPIT | KAPPA |
| 1.3M | COV096_HC_140-P1369 | 3527 | EVQLVESGGGLVKPGGSLRLSCAASGFTVRSYSMNWVRQAPGKGLEWVSCMTSSGSYLYYADSVKGRFTISRDNAKNSLYLQMNSLRDEDTAVYYCAKEEYYGMDVWGQGATVTVSS | 3528 | AKEEYYGMDV | COV096_KC_140-P1389 | 3529 | DIQMTQSPSSLSASVGDRVTITCRASQDISSWLAWYQQKPGKAPKLLIYAASNLQSGVPSRFSGSGSGTHFTLTISSLQPEDFVTYYCQQANRFPITFGQGTRLEIK | 3530 | QQANRFPIT | KAPPA |
| 1.3M | COV096_HC_153-P1369 | 3531 | QVQLVQSGAEVKKPGSSVKVSCKASGGTFSSNAISWVRQAPGQGLEWMGGITPIFGTVNYAQKFQGRVTITADESTSTAYMELSSLRSEDTAVYYCASEWEIFGFDYWGQGTLVTVSS | 3532 | ASEWEIFGFDY | COV096_KC_153-P1389 | 3533 | DIQMTQSPSSLSASVGDRVTITCRASQSISRYLNWYQQKSGKAPKLLIYAASSLQSGVPSRFSGSGSGTDFTLTISSLQPEDFATYYCQQSYSTPWTFGQGTKVEIK | 3534 | QQSYSTPWT | KAPPA |
| 1.3M | COV096_HC_156-P1369 | 3535 | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLPPRRFDIWGQGTMVTVSS | 3536 | ARDLPPRRFDI | COV096_KC_156-P1389 | 3537 | DIQMTQSPSSLSASVGDRVTITCQASQDISNYLNWYQQKPGKAPKLLIYDASNLETGVPSRFSGSGSGTDFTFTISSLQPEDIATYYCQQFDNLPITFGQGTRLEIK | 3538 | QQFDNLPIT | KAPPA |
| 1.3M | COV096_HC_158-P1369 | 3539 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEPIGQPLLWWDYWGQGTLVTVSS | 3540 | AKEPIGQPLLWWDY | COV096_KC_158-P1389 | 3541 | EIVLTQSPATLSLSPGERATLSCRASQSVSSYLAWYQQKPGQAPRLLIYDASNRATGIPARFSGSGSGTDFTLTISSLEPEDFAVYYCQQRSNWPRGFGQGTKVEIK | 3542 | QQRSNWPRG | KAPPA |
| 1.3M | COV096_HC_164-P1369 | 3543 | EVQLLESGGGLVQPGTSLRLSCAASGFTFSSYAMSWVRQAPGKGLEWVSAISSSGGSTYYADSVKGRFTISRDNSKNTLYLHMNSLRAEDTAVYYCATERIAVAGTRMYNWFDPWGQGTLVTVSS | 3544 | ATERIAVAGTRMYNWFDP | COV096_KC_164-P1389 | 3545 | DIQMTQSPSSLSASVGDRVTLTCRASQSISSYLNWYQQKPGKAPNLLIYAASSLQSGVPSRFSGSGSGTDFTLTISSLQPEDFATYYCQQSYSAPPWTFGQGTKVEIK | 3546 | QQSYSAPPWT | KAPPA |
| 1.3M | COV096_HC_166-P1369 | 3547 | EVQLVESGGGLVKPGGSLRVSCAASGFSFSYAWMSWVRQAPGKGLEWVGRIKSKTDGGTTDCAAPVKGRFTISRDDSKNTLYLQMNSLKTEDTAVYYCTTLSDYGDLSSVYWGQGTLVTVSS | 3548 | TTLSDYGDLSSVY | COV096_KC_166-P1389 | 3549 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | 3550 | QQSYSTPLT | KAPPA |
| 1.3M | COV096_HC_183-P1369 | 3551 | EVQLVESGGGLIQPGGSLRLSCAASGLTVSRNYMNWVRQAPGKGLEWVSVMYSGGSTFYADSVKGRFTISRDNSKNTLYLQMNSLRAEDTAVYYCARESYGMDVWGQGTTVTVSS | 3552 | ARESYGMDV | COV096_KC_183-P1389 | 3553 | EIVLTQSPGTLSLSPGERATLSCRASQSFSSTYLAWYQQKPGQAPRLLIYGASSRATGIPDRFSGSGSGTDFTLTISRLEPEDFAVYYCQQYVTSPWTFGQGTKVEIK | 2554 | QQYVTSPWT | KAPPA |
| 1.3M | COV096_HC_21-P1369 | 3555 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDTPGGDDILTGWGLYGMDVWGQGTTVTVSS | 3556 | AKDTPGGDDILTGWGLYGMDV | COV096_KC_21-P1389 | 3557 | DIQMTQSPSSLSASVGDRVTITCRASQSISSYLNWYQQKPGKAPKLLIYAAFSLQSGVPSRFSGSGSGTDFTLTISSLQPEDFATYYCQQSYSTPWTFGQGTKVEIK | 3558 | QQSYSTPWT | KAPPA |
| 1.3M | COV096_HC_ | 3559 | EVQLLESGGGLVQPGGSLRLSCAASGFTFSSYAMSWVRQAPGKGLEWVSAITDSGDGTFYAD | 3560 | ASEEDYSNYVGWF | COV096_KC_ | 3561 | DIQMTQSPSSLSASVGDRVTITCRASQSISSYLNWYQQKPGKAPKLLIYAASSL | 3562 | QQSYST | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| | 25-P1369 | | SVKGRFTISRDNSKNTLYLQMNSLRAEDTAVYYCASEEDYSNYVGWFDPWGQGTLVTVS | | DP | 25-P1389 | | QSGVPSRFSGSGSGTDFTLTISSLQPEDFATYYCQQSYSTPPWTFGQGTKVEIK | | PPWT | |
| 1.3M | COV096_HC_28-P1369 | 3563 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARMVTSGTYYYDNSGYSSSGPFDYWGQGTLVTVSS | 3564 | ARMVTSGTYYYDNSGYSSSGPFDY | COV096_KC_28-P1389 | 3565 | AIQLTQSPSSLSASVGDRVTITCRASQGISSALAWYQQKPGKAPKLLIYDASSLESGVPSRFSGSGSGTDFTLTISSLQPEDFATYYCQQFNNFGPGTKVDIK | 3566 | QQFNN | KAPPA |
| 1.3M | COV096_HC_34-P1369 | 3567 | EVQLVESGGGLVQPGGSLRLSCAASGFTVSSNYMSWVRQAPGKGLEWVSLIYSGGSTYYADSVKGRFTISRDNSKNTLYLQMNTLRAEDTAVYYCARDTLGRGGDYWGQGTLVTVSS | 3568 | ARDTLGRGGDY | COV096_KC_34-P1389 | 3569 | DIQMTQSPSSLSASVGDRVTITCQASQDISNYLNWYQQKPGKAPKVLIYDASNLETGVPSRFSGSGSGTDFTFTISSLQPEDIATYFCQQYDNLPRSFGQGTKLEIK | 3570 | QQYDNLPRS | KAPPA |
| 1.3M | COV096_HC_3-P1369 | 3571 | EVQLVESGGGLVQPGRSLRLSCTASGFTFGDYAMNWFRQAPGKGLEWVGFIRSKAYGGTTEYAASVRGRFTISRDDSESIAYLQMNSLKTEDTAVYYCTRDLSYYYDSSGRGSHLFDYWGQGTLVTVSS | 3572 | TRDLSYYYDSSGRGSHLFDY | COV096_KC_3-P1389 | 3573 | EIVMTQSPATLSVSPGERATLSCRASQSVSSNLAWYQQKPGQAPRLLIYGASTRATGIPARFSGSGSGTEFTLTISSLQSEDFAVYYCQQYNNWWTFGQGTKVEIK | 3574 | QQYNNWWT | KAPPA |
| 1.3M | COV096_HC_42-P1369 | 3575 | QVQLVQSGAEVKKPGSSVKVSCKASGGTISSYAISWVRQAPGQGLEWMGGIIPIFGTTNYAQKFQGRVTITADESTSTAYMELSSLRSEDTALYYCARDDGQQLWSYFDYWGQGTLVTVSS | 3576 | ARDDGQQLWSYFDY | COV096_KC_42-P1389 | 3577 | DIVMTQSPDSLAVSLGERATINCKSSQSVLYSSNNKSYLAWYQQKPGQPPKLLIYWASTRESGVPDRFSGSGSGTDFTLTISSLQAEDVAVYYCQQYYSTLPLTFGGGTKVEIK | 3578 | QQYYSTLPLT | KAPPA |
| 1.3M | COV096_HC_43-P1369 | 3579 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYFCAKQLYYYGSGSYVFDYWGQGTLVTVSS | 3580 | AKQLYYYGSGSYVFDY | COV096_KC_43-P1389 | 3581 | DIQMTQSPSSLSASVGDRVTITCQASQDIRNFLNWYQQKPGKAPKLLIYDASNLETGVPSRFSGSGSGTDFTFTISSLQPEDIATYYCQQYDNLPLTFGGGTKVEIK | 3582 | QQYDNLPLT | KAPPA |
| 1.3M | COV096_HC_45-P1369 | 3583 | EVQLVESGGGLVQPGGSLRLSCAASGFNFSTHWMHWVRQAPGKGLVWVSRINSDGSRRAYATSVKGRFTISRDNAKNTLYLQMDSLRDEDTAVYYCTRDDSSWPHFFDNWGQGTLVAVSS | 3584 | TRDDSSWPHFFDN | COV096_KC_45-P1389 | 3585 | DIQMTQSPSSLSASVGDRVTITCQASQDISNYLNWYQQKPGKAPKLLIYDASNLETGVPSRFSGSGSGTDFTFTISSLQPEDIATYYCQQYDNLPPKLTFGGGTKVEIK | 3586 | QQYDNLPPKLT | KAPPA |
| 1.3M | COV096_HC_48-P1369 | 3587 | EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARASGLRSYYYYGMDVWGQGTTVTVSS | 3588 | ARASGLRSYYYYGMDV | COV096_KC_48-P1389 | 3589 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPATFGQGTKVEIK | 3590 | QQSYSTPAT | KAPPA |
| 1.3M | COV096_HC_4-P1369 | 3591 | QVQLVQSGAEVKKPGASVKVSCKASGSTFTGYYMHWVRQAPGQGLEWMGWINPNSGGTNYAQKFQGWVTMTRDTSISTAYMELSRLRSDDTAVYYCAREKVATMFALPPYGMDVWGQGTTVTVSS | 3592 | AREKVATMFALPPYGMDV | COV096_KC_4-P1389 | 3593 | EIVLTQSPATLSLSPGERATLSCRASQSVSSYLAWYQQKPGQTPRLLIYDASNRATGIPARFSGSGSGTDFTLTISSLEPEDFAVYYCQQRSNWPPIAFGQGTRLEIK | 3594 | QQRSNWPPIA | KAPPA |

TABLE 9-continued

Sequence pairs of antibody heavy and light chain variable regions from six individuals at 1.3 and 6.2 month time points.

| | | | | | | | | | | | |
|---|---|---|---|---|---|---|---|---|---|---|---|
| 1.3M | COV096_HC_55-P1369 | 3595 | QVQLVQSGAEVKKPGSSVKVSCKASGGTFSSYAISWVRQAPGQGLEWMGGIIPIFGTTNHAQKFQGRVTITADESTSTAYMELSSLRSEDTAVYYCTSGQGAGVNRGVVITTLGYWGQGTLVTVSS | 3596 | TSGQGAGVNRGVVITTLGY | COV096_KC_55-P1389 | 3597 | DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPCSFGQGTKLEIK | 3598 | QQYYSTPCS | KAPPA |
| 1.3M | COV096_HC_65-P1369 | 3599 | EVQLVESGGGLVQPGGSLRLSCAASGFTFSSYDMHWVRQATGKGLQWVSAIGTAGDTYYPDSVKGRFTISRENAKNSLYLQMNSLRAGDTAVYYCARDRDSSWSFDYWGQGTLVTVSS | 3600 | ARDRDSSWSFDY | COV096_KC_65-P1389 | 3601 | DIQMTQSPSSLSASVGDRVTITCRASQSISSYLNWYQQKPGKAPKLLIYAASSLQSGVPSRFSGGGSGADFTLTISSLQPEDFATYYCQQSYSTPPITFGQGTRLEIK | 3602 | QQSYSTPPIT | KAPPA |
| 1.3M | COV096_HC_68-P1369 | 3603 | EVQLVESGGGLIQPGGSLRLSCAASGVIVSSNYMSWVRQAPGKGLEWVSVIYSGGSTYYADSVKGRFTISRDNSKNTLYLQMNSLRAEDTAVYYCARDGGHYGMDVWGQGTTVTVSS | 3604 | ARDGGHYGMDV | COV096_KC_68-P1389 | 3605 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPAFGQGTRLEIK | 3606 | QQLNSYPPA | KAPPA |
| 1.3M | COV096_HC_6-P1369 | 3607 | EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCVKGVEYSSSSNFDYWGQGTLVTVSS | 3608 | VKGVEYSSSSNFDY | COV096_KC_6-P1389 | 3609 | DIQMTQSPSSVSASVGDRVTITCRASQGISSWLAWYQQKPGKAPKLLIYVESSLQSGVPSRFSGSGSGTDFTLTISSLQPEDFATYYCQQANSFPLTFGGGTKVEIK | 3610 | QQANSFPLT | KAPPA |
| 1.3M | COV096_HC_72-P1369 | 3611 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARRPRDYYDRSGYYYVPGYFDYWGQGTLVTVSS | 3612 | ARRPRDYYDRSGYYYVPGYFDY | COV096_KC_72-P1389 | 3613 | DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIK | 3614 | QQYDNLPLT | KAPPA |
| 1.3M | COV096_HC_74-P1369 | 3615 | EVQLVESGGGLVQPGGSLRLSCAASGFIVSSNYMSWVRQAPGKGLEWVSVIYSGGSTYYADSVKGRFTISRDNSKNTLYLQMNSLRAEDTAVYYCARDYGDFYFDYWGQGTLVTVSS | 3616 | ARDYGDFYFDY | COV096_KC_74-P1389 | 3617 | EIVMTQSPATLSVSPGERATLSCRASQSVSSNLAWYQQKPGQAPRLLIYGASTRATGIPARFSGSGSG1EFTLTISSLQSEDFAVYYCQQYNNWPRTFGQGTKVEIK | 3618 | QQYNNWPRT | KAPPA |
| 1.3M | COV096_HC_75-P1369 | 3619 | EVQLVESGGGLVQPGGSLRLSCAASGFTFSSYDMHWVRQATGKGLEWVSAIGTAGDTYYPDSVKGRFTISRENAKNSLYLQMNSLRAGDTAVYYCARDRGSSGWYGWYFDLWGRGTLVTVSS | 3620 | ARDRGSSGWYGWYFDL | COV096_KC_75-P1389 | 3621 | DIQMTQSPSSLSASVGDRVTITCRASQSISSYLNWYQQKPGKAPKLLIYVASSLQSGVPSRFSGSGSGTDFTLTISSLQPEDFATYYCQQSYSTPPITFGQGTRLEIKK | 3622 | QQSYSTPPIT | KAPPA |
| 1.3M | COV096_HC_78-P1369 | 3623 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEPIGQPLLWWDYWGQGTLVTVSS | 3624 | AKEPIGQPLLWWDY | COV096_KC_78-P1389 | 3625 | EIVLTQSPATLSLSPGERATLSCRASQVSSYLAWYQQKPGQAPRLLIYDASNRATGIPARFSGSGSGTDFTLTISSLEPEDFAVYYCQQRSNWPRGFGQGTKVEIK | 3626 | QQRSNWPRG | KAPPA |
| 1.3M | COV096_HC_79-P1369 | 3627 | EVQLVESGGGLVQPGGSLRLSCAASGFTFTNYNMNWVRQAPGKGLEWVSYISSSSSTIYYADSVKGRFTISRDNAKNSLYLQMNSLRDEDTAVYYCARVVGSGSYYYYGMDVWGQGTTVTVSS | 3628 | ARVVGSGSYYYYGMDV | COV096_KC_79-P1389 | 3629 | DIQMTQSPSSLSASVGDRVTITCRASQSISSYLNWYQQKPGKAPKLLIYGASQSGVPSRFSGSGSGTDFTLTISSLQPEDFATYYCQQSYSTPATFGQGTKLEIK | 3630 | QQSYSTPAT | KAPPA |

TABLE 9-continued

Sequence pairs of antibody heavy and light chain variable regions from six individuals at 1.3 and 6.2 month time points.

| | Heavy Chain SEQUENCE_ID | SEQ ID NO | aa | SEQ ID NO | cdr3_aa | Light Chain SEQUENCE_ID | SEQ ID NO | aa | SEQ ID NO | cdr3_aa | |
|---|---|---|---|---|---|---|---|---|---|---|---|
| 1.3M | COV096_HC_81-P1369 | 3631 | EVQLVESGGGLVQPGGSLRLSCAASGFTFSSYDMHWVRQASGKGLEWVSAIGTSGDTYYPGSVKGRFTISRENAKNSLYLQMNSLRAGDTAVYYCARGTFFYGSGSYNWFDPWGQGTLVTVS | 3632 | ARGTFFYGSGSYNWFDP | COV096_KC_81-P1389 | 3633 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK | 3634 | QQSYSTPPWT | KAPPA |
| 1.3M | COV096_HC_8-P1369 | 3635 | EVQLVQSGAEVKKPGESLKISCKGSGYTFTSYWIGWVRQMPGKGLEWMGFIYPGDSDTRYSPSFQGQVTISADKSISTAYLQWSSLKASDTAMYYCARPVTYDWYFDLWGRGTLVTVSS | 3636 | ARPVTYDWYFDL | COV096_KC_8-P1389 | 3637 | DIQMTQSPSSVSASLGDRVTITCRASQGISSWLAWYQQKPGKAPKVLIYAASSLQSGVPSRFSGSGSGTDFTLTISSLQPEDFATYYCQQANSFPITFGQGTRLEIK | 3638 | QQANSFPIT | KAPPA |
| 1.3M | COV096_HC_91-P1369 | 3639 | EVQLLESGGGLEQPGGSLRLSCAASGFTFSTYAMSWVRQAPGKGLEWVSAISGSGAGTFYADSVKGRFTISRDNSKNTLYLQMNSLRAEDTAVYYCARESDCGSTSCYQVGWFDPWGQGTLVTVSS | 3640 | ARESDCGSTSCYQVGWFDP | COV096_KC_91-P1389 | 3641 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK | 3642 | QQSYSTPPWT | KAPPA |
| 1.3M | COV096_HC_98-P1369 | 3643 | QVQLVESGGGVVQPGRSLRLSCAASGFTFSSYGMHWVRQAPGKGLEWVAAIWYDGSNKHYADSVKGRFTISRDNSKNTLYLQMNSLRAEDTAVYYCARDVGRVTTWFDPWGQGTLVTVSS | 3644 | ARDVGRVTTWFDP | COV096_KC_98-P1389 | 3645 | DIQMTQSPSSLSASVGDRVTITCRASQSISSYLTWYQQKPGKAPKLLIYAASSLQSGVPSRFSGSGSGTDFTLTISSLQPEDFATYYCQQSYSTPPWTFGQGTKVEIK | 3646 | QQSYSTPPWT | KAPPA |
| | COV107_6mo_P1_IGG_A10-P1369 | 3647 | QVQLVQSGAEVKKPGASVKVSCKASGYTFTAYYIHWVRQAPGQGLEWMGWISPISGGTKYAQKFQGRVTMTRDTSITTTYMDLSRLRSDDTAVYYCARDLKAVAISGDIDYWGQGTLVTVSS | 3648 | ARDLKAVAISGDIDY | COV107_6mo_P1_Lambda_A10-P1409 | 3649 | QSVLTQPASVSGSPGQSITISCTGTSSDVESYNLVSWYQQYPGKAPKLMIYEGSKRPSGLSNRFSGSKSGNTASLTISGLQAEDEADYYCFSYAGSNTWVFGGGTKLTVL | 3650 | FSYAGSNTWV | LAMBDA |
| | COV107_6mo_P1_IGG_A11-P1369 | 3651 | EVQLVQSGAEVKRPGESLKISCKTSGYSFTSHWIGWVRQMPGKGLEWMGIIYPGDYDTRYNPSFQGQVTISADKSINTAFLQWSSLKASDSAIYYCSRRQGSYPPYFDYWGQGALVTVSS | 3652 | SRRQGSYPPYFDY | COV107_6mo_P1_Lambda_A11-P1409 | 3653 | SYVLTQPPSVSVAPGKTARITCGGNNIGSKRVHWYQQKPGQAPVLVISYDSDRPSGIPERFSGSNSGNTATLTISRVEAGDEADYYCQVWDSNSDYYVFGTGTKVTVL | 3654 | QVWDSNSDYYV | LAMBDA |
| | COV107_6mo_P1_IGG_A3-P1369 | 3655 | QVQLVQSGAEVKKPGASVKVSCKASGYTFTDYFNHWVRQAPGQGLEWMGWINPNSGGTNSAQKFQGRVTMTRDTSITTVYMELSRLRSDDTAVYYCARYKGTTVNTNYYYGMDVWGQGTTVTVSS | 3656 | ARYKGTTVNTNYYYGMDV | COV107_6mo_P1_Lambda_A3-P1409 | 3657 | SYVLTQPPSVSVSPGQTASITCSGDKLRNKYACWYQQKAGQSPMLVIYQDTKRPSGIPERFSGSNSGNTATLTISGTQAMDEADYYCQAWDISTVVFGGGTKLTVL | 3658 | QAWDISTVV | LAMBDA |

TABLE 9-continued

Sequence pairs of antibody heavy and light chain variable regions from six individuals at 1.3 and 6.2 month time points.

| | | | | | | | | | |
|---|---|---|---|---|---|---|---|---|---|
| COV107_6mo_P1_IGG_A5-P1369 | 3659 | EVQLVQSGAEVKKPGESLKISCKGSGYSFTSYWIGWVRQMPGKGLEWMGIFFPGNSDARYSPQGQVIMSADKSISTAYLQWSSLRASDTAMYYCARNGMHYGSGSYYNGFDPWGQGTLVTV | 3660 | ARNGMHYGSGSYYNGFDP | COV107_6mo_P1_Lambda_A5-P1409 | 3661 | QSVLTQPPSASGTPGQRVTISCSGSSSNIGSNTVNWYQQLPGTAPKLLIHSNNQRPSGVPDRFSGSKSGTSASLAISGLQSEDEGDYYCATWDDSLSGVVFGGGAKVTVL | 3662 | ATWDDSLSGVV | LAMBDA |
| COV107_6mo_P1_IGG_A8-P1369 | 3663 | QVQLVESGGGVVQPGRSLRLSCAASGFIFSSYGMHWVRQAPGKGLEWVAVISYDGSKKYYADSVKGRFTISRDNSKNTLYLQMNSLRAEDTAVHYCAKDQGYGDFYYYFGMDVWGQGTTVTVSS | 3664 | AKDQGYGDFYYYFGMDV | COV107_6mo_P1_Lambda_A8-P1409 | 3665 | QSALTQPPSVSGSPGQSVTISCTGTSSDVGSYNRVSWYQQPPGTAPKLMIYEVTNRPSGVPDRFSGSKSGNTASLTISGLQAEDEADYYCSSYTSSSLIFGGGTKLTVL | 3666 | SSYTSSSLI | LAMBDA |
| COV107_6mo_P1_IGG_B11-P1369 | 3667 | QVQLQESGPGLVKPSETLSLTCTVSGDSISSYFWSWIRQPPGRGLEWIGYIHDSVNTNYNPSLKSRVTISVDTSKSQFSLRLSSVTAADTAVYYCARCAWLRGSFDYWGQGTMVTVSS | 3668 | ARCAWLRGSFDY | COV107_6mo_P1_Lambda_B11-P1409 | 3669 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDFSSHYVFGTGTKVTVL | 3670 | QSYDFSSHYV | LAMBDA |
| COV107_6mo_P1_IGG_B1-P1369 | 3671 | EVQLVESGGGLVQPGGSLRLSCAASGFIFSRYWMHWVRQAPGKGLVWVSRINSDGSNTTYADSVKGRFTISRDNAKNTLYLQMNSLRAEDTAVYYCARDLEYYDFWSGLSGDWSFDLWGRGTLVTVSS | 3672 | ARDLEYYDFWSGLSGDWSFDL | COV107_6mo_P1_Lambda_B1-P1409 | 3673 | QSVLTQPPSVSGAPGQRVTISCTGSSSNIGAGYDVQWYQQLPGTAPKLLIYGNSNRPSGVPDRFSGSKSGTSASLAITGLQAEDEASYYCQSYDSSLEVFGTGTKVTVL | 3674 | QSYDSSLEV | LAMBDA |
| COV107_6mo_P1_IGG_B9-P1369 | 3675 | EVQLVQSGAEVKKPGESLKISCKGSGYRFTSYWIGWVRQMPGKGLEWMAIIFPGDSETRYSPSFQGQVTISADKSISTAYLQWSSLKASDTAMYYCARLLHYYDRSGYSGATDDAFDIWGQGTMVTVSS | 3676 | ARLLHYYDRSGYSGATDDAFDI | COV107_6mo_P1_Lambda_B9-P1409 | 3677 | QSVLTQPPSVSGAPGQRVTISCTGSSSNIGAGYDVHWYQQLPGTAPKLLIYGNSNRGVPDRFSGSKSGTSASLAITGLQAEDEADYYCQSYDSSLSGLVLFGGGTKLTVL | 3678 | QSYDSSLSGLVL | LAMBDA |
| COV107_6mo_P1_IGG_C12-P1369 | 3679 | EVQLLESGGGLVQPGGSLRLSCAASGFTFSSYVMSWVRQAPGKGLEWVSGISGSGGSPYYADSVKGRFTISRDNSKNTLYLQMNSLRAEDTAVYYCAKDGDIVVALNDGFDIWGQGTMVTVSS | 3680 | AKDGDIVVALNDGFDI | COV107_6mo_P1_Lambda_C12-P1409 | 3681 | SYVLTQPPSVSVAPRKTARITCGGHNIGSKNVHWYQQRPGQAPVLVIYSDSDRPSGIPERFSGSNSGNTATLTISRIEAGDEADYYCQVWDGSSDHPVIFGGGTKLTVL | 3682 | QVWDGSSDHPVI | LAMBDA |
| COV107_6mo_P1_IGG_C9-P1369 | 3683 | EVQLVESGGGLIQPGGSLKLSCVVSGFTVSRNYISWVRQAPGKGLEWVSVLFAGGSTFYADSVKGRFAISRDNSNNTLFLQMNSLRVEDTAIYYCARGDGELIFDQWGQGTLVTVSS | 3684 | ARGDGELIFDQ | COV107_6mo_P1_Lambda_C9-P1409 | 3685 | QSVLTQPPSVSGAPGQRVTIVCTGTSSNIGAGYDVHWYQQLPGRAPKVLVSGNNIRPSEVPDRFSGSRSGTSASLAITSLQPEDEAQYYCQSYDSNLYAVFGGGTKLTVL | 3686 | QSYDSNLYAV | LAMBDA |
| COV107_6mo_P1_IGG_D1-P1369 | 3687 | EVQLVESGGGLIQPGGSLRLSCAASGFSVSSNFMSWVRQAPGKGLEWVSLIYTGGSTYYADSVKGRFTISRDNSNNTLYLQMNSLRADDTAVYYCARTLGWWELDPWGQGTLVTVSS | 3688 | ARTLGWWELDP | COV107_6mo_P1_Lambda_D1-P1409 | 3689 | QSVLTQPPSVSGVPRQRVTISCSGSNSNIGNNAVNWYQQLPGKAPKLLIYYNDLLPSGFSDRFSGSKSGTSASLAISGLQSEDEADYYCAAWDDSLNGPVFGGGTKVTVL | 3690 | AAWDDSLNGPV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_6mo_P1_IGG_D8-P1369 | 3691 | QVQLQESGPGLVKPSQTLSLTCTVSGGSISSGGYHWSWIRQHPGKGLEWIGYIYYSGNTYYNPSLKSRVTMSLDTSKSQFSLNLSSVTAADTAVYYCARFDVFIPADAFDIWGQGTLVTVSS | 3692 | ARFDVFIPADAFDI | COV107_6mo_P1_Lambda_D8-P1409 | 3693 | QFVLTQPRSVSGSPGQSVTISCTGTSSDVGGYNYVSWYQQHPGKVPKLLTYDVSKRPSGVPDRFSGSKSGNTASLTISGLQAEDEADYYCCSYAGTYTVVFGGGTKVTV | 3694 | CSYAGT | LAMBDA |
| COV107_6mo_P1_IGG_E2-P1369 | 3695 | QLQLQESGPGLVKPSETLSLTCTVSGGSISSSNDYWGWIRQPPGKGLEWIGSIFYSGITYYNPSLESRVTISVDTSKNQFSLKLSSVTAADTAVFYCARLIRYCSTTSCYSFDFWGQGTLVTVSS | 3696 | ARLIRYCSTTSCYSFDF | COV107_6mo_P1_Lambda_E2-P1409 | 3697 | QSVLTQPASVSGSPGQSITISCTGTTSDVGSYNLVSWYQQHPGKAPKVMIFEVDKRPSGVSNRFSGSKSGNTASLTISGLQAEDEADYYCCSYVGSSSVIFGGGTKLTVL | 3698 | CSYVGSSSVI | LAMBDA |
| COV107_6mo_P1_IGG_E3-P1369 | 3699 | QVQLQESGPGLVKPSQTLSLTCTVSGGSISSGGYYWTWIRQYPGEGLEWIGYIYHSGSAYYNPSLKSRVTMSVDTSKNQFSLKLSSVTAADTAVYYCARAIVVVTLNWFDPWGQGTLVSVSS | 3700 | ARAIVVVTLNWFDP | COV107_6mo_P1_Lambda_E3-P1409 | 3701 | NFMLTQPHSVSESPGKTVTISCTGSSGSIASNYVQWYQQRPGSAPTAVIYEDNQRPSGVPDRFSGSIDSSSNSASLTISGLKTEDEADYYCQSYDSSNPVVFGGGTKLTVL | 3702 | QSYDSSNPVV | LAMBDA |
| COV107_6mo_P1_IGG_E8-P1369 | 3703 | QVQLVESGGGLVKPGGSLRLSCAVSGIDFTDYFMSWVRQAPGKGLEWISYIRSGNSYTDYADSVKGRFTISTDNAKNSLYLQMNSLRAEDTAVYYCASAPWLRGHFDYWGQGALVTVSS | 3704 | ASAPWLRGHFDY | COV107_6mo_P1_Lambda_E8-P1409 | 3705 | NFMLTQPHSVSESPGKTVTISCTGSSGSIASNYVHWYQQRPGSAPTTVIYEDNQRPSGVPDRFSGSIDSSSNSASLTISGLKTDDEADYYCQSFDSNTGRVFGGGTKLTVL | 3706 | QSFDSNTGRV | LAMBDA |
| COV107_6mo_P1_IGG_F10-P1369 | 3707 | QVQLVQSGAEVKKPGASVKVSCKASGYTFTSYYMHWVRQAPGQGLEWMGIINPTGGTTRYAQKFQGRVTMTRDTSTSTVYMELSSLRSEDTAVYYCARAPLYYDILTGYYPGAYDYWGQGTLVTVSS | 3708 | ARAPLYYDILTGYYPGAYDY | COV107_6mo_P1_Lambda_F10-P1409 | 3709 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKLTVL | 3710 | SSYTSSSTVV | LAMBDA |
| COV107_6mo_P1_IGG_F11-P1369 | 3711 | QVQLVESGGGVVQPGRSLRVSCAASGFTFSTFAMHWVRQAPGKGLEWVAVISYDGGNRFYVDSVEGRFTISRDNSKNTLSLQMNSLRTEDTAVYYCARGGFGGLWFGQGTLVTVSS | 3712 | QHRYNWLT | COV107_6mo_P1_Lambda_F11-P1409 | 3713 | NFMLTQPHSMSESPGKTVTISCTGSGGSIALNYVEWYQQRPGSAPTTVIYEDNQRPSGVPDRFSGSIDSSSNSASLTISGLKTEDEADYYCQSYDGTTRGHVVFGGGTKLTVL | 3714 | QSYDGTTRGHVV | LAMBDA |
| COV107_6mo_P1_IGG_F4-P1369 | 3715 | EVQLVESGGGLVQPGGSLRLSCAASGFTFSSYRMHWVRQAPGKGPVWVSRINSDESNISYADSVKGRFTISRDNAKNTLYLQMNSLRAEDTAVYYCAREVHNEPGDYFDYWGQGTLVSVS | 3716 | AREVHNEPGDYFDY | COV107_6mo_P1_Lambda_F4-P1409 | 3717 | SYVLTQPPSVSVAPGKTARITCGGNNIGSKSVHWYQQKPGQAPVLVIYYDSDRPIPERFSGSNSGNTATLTISRVEAGDEADYYCQVWDSSGDHWVFGGGTKLTVL | 3718 | QVWDSSGDHWV | LAMBDA |
| COV107_6mo_P1_IGG_G12-P1369 | 3719 | QVQLQESGPGLVKPSETLSLTCTVSGGSVFSGTYYWSWIRQPPGKGLEWIGYIYYSGSTNYNPSLKSRVTISIDPSKNQFSLNLSSVTAADTAVYYCARGSRSSYYFDYWGQGALVTVSS | 3720 | ARGSRSSYYFDY | COV107_6mo_P1_Lambda_G12-P1409 | 3721 | QSVLTQPPSVSAAPGQKVTISCSGSSSNIGNNYVSWYQQLPGTAPKLLIYEDNKRPSGIPDRFSGSKSGTSATLGIAGLQTGDEADYYCGTWDSSLSVPFVFGTGTKVTV | 3722 | GTWDSSLSVPFV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_6mo_P1_IGG_G2-P1369 | 3723 | QVQLQESGPGLVKPSQTLSLTCTVSGGSITSGDYYWTWIRQPPGKGLEWIGYIYYSGNTYYNLSLRSRITISEDTSKNQFSLKLRSVTAADTAVYYCARAMITFGGVIVVLDYWGQGTLVTVSS | 3724 | ARAMITFGGVIVVLDY | COV107_6mo_P1_Lambda_G2-P1409 | 3725 | QSVLTQPPSASGSPGQSVTISCTGTSTDVGGYNFVSWYQQHPGKAPKLMIYEVSKRPSGVPDRFSGSKSGNTASLTVSGLQAEDEADYYCSSYAGSNILYVFGTGTKVTVL | 3726 | SSYAGSNILYV | LAMBDA |
| COV107_6mo_P1_IGG_G3-P1369 | 3727 | QVQLVESGGGVVQPGRSLRLSCSASGFTFSSYAFHWVRQAPGKGLEWVAVVSHDGNNKFYADSVKGRLAIYRDNSKNTLYLQMISLQAEDTALYYCARDLGVVLPGPADDYFYFYGMDVWGLGTTVTVSS | 3728 | ARDLGVVLPGPADDYFYFYGMDV | COV107_6mo_P1_Lambda_G3-P1409 | 3729 | SYVLTQPPSVSVSPGQTARISCSGGALPKQYGYWYQQKPGQAPVLVIYKDSERPSGIPERFSGSSSGTAVTLTISGVQAEDEADYYCQSADRSGMSRVFGGGTKLTVL | 3730 | QSADRSGMSRV | LAMBDA |
| COV107_6mo_P1_IGG_G7-P1369 | 3731 | QVQLQESGPGLVKPSGTLSLTCAVSGGSISTVNWWSWVRQPPGKGLEWIGEIHHSGNTNHNPSLRSRVTISVDKSKNQFSLKLRSVTAADTAVYYCARDGGRPGDAFDLWGQGTMVTVSS | 3732 | ARDGGRPGDAFDL | COV107_6mo_P1_Lambda_G7-P1409 | 3733 | QSVLTQPASVSGSPGQSITISCTGTSSDVGGYNYVSWYQQHPGKVPKVMIYDVSNRPSGISNRFSGSKSGNTASLTISGLQAEDEADYYCNSYRSNSTRVFGTGTKVTV | 3734 | NSYRSNSTRV | LAMBDA |
| COV107_6mo_P1_IGG_G9-P1369 | 3735 | QVQLQESGPGLVKPSQTLSLTCTVSGGSISRYYWSWLRQHPGKGLEWIGCIYDSGSTNYNPSLKSRLTISVDTSQNQLSLKLASVTAADAAVYYCARVPVGWEPPGFDLWGQGTTVTVSS | 3736 | ARVPVGWEPPGFDL | COV107_6mo_P1_Lambda_G9-P1409 | 3737 | SYVLTQPPSVSVAPGKTARVTCGGNNIGSKSVHWYQQKPGQAPVLVIYYDTDRPSGIPERFSGSNSGNTATLTISRVEAGDEADYYCQVWDSSSDHPVFGGGTKLTV | 3738 | QVWDSSSDHPV | LAMBDA |
| COV107_6mo_P1_IGG_H4-P1369 | 3739 | EVQLVQSGAEVKKPGESLKISCKGSGYTFTNYWIGWVRQMPGKGLEWMGIIYPGDSDTRYSPSFQGQVTISADKSISTAYLQWSSLKASDTAMYYCAIGALQMATIIDAFDIWGQGTMVTVSS | 3740 | AIGALQMATIIDAFDI | COV107_6mo_P1_Lambda_H4-P1409 | 3741 | QSVLTQPPSASGTPGQRVTISCSGSSSNIGGNAVNWYQQLPGTAPKLLIYTNNQRPSGVPDRFSGSKSGTSASLSISGLQSEDEADYYCAAWDDSLNGVVFGGGTKLTAL | 3742 | AAWDDSLNGV | LAMBDA |
| COV107_6mo_P1_IGG_H6-P1369 | 3743 | EVQLVESGGGLIQPGGSLRLSCAASGLTVSRNYMTWVRQAPGKGLEWVSVIYSGGTTHYADSVKGRFTISRDNSKNTLYLQMNSLRAEDTAVYYCARDLAVYGMDVWGQGTTVTVSS | 3744 | ARDLAVYGMDV | COV107_6mo_P1_Lambda_H6-P1409 | 3745 | QSVLTQPPSVSGAPGQRVTISCTGSSSNIGAGSDVHWYQKLPGTAPKVLVYGYSNRPSGVPDRFSGSKSGTSASLAITGLQAEDEADYYCQSYDTSLRVLFGGGTKLTV | 3746 | QSYDTSLRVL | LAMBDA |
| COV107_6mo_P2_IGG_A11-P1369 | 3747 | QVQLVQSGAEVKKPGASVMLSCKASGYTFTSYGISWVRQAPGQGLEWMGWISAYNGNTNYAQKLQGRVSMTTDTSTSTAYMELRSLRSDDTAVYYCARAMAVAGTSGDFDYWGQGTLVTVSS | 3748 | ARAMAVAGTSGDFDY | COV107_6mo_P2_Lambda_A11-P1409 | 3749 | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGHVVFGGGTKLTVL | 3750 | AAWDDSLNGHVV | LAMBDA |
| COV107_6mo_P2_IGG_A6-P1369 | 3751 | QVQLVQSGAEVKKSGSSVKVSCKASGGSFSSYAISWVRQAPGQGLEWMGGIIPIFGTAKYAQKFQGRVTITADESTSTAYMELSSLRSEDTAVYYCASRWEQLNGGSWHYFDYWGQGTLVTVSS | 3752 | ASRWEQLNGGSWHYFDY | COV107_6mo_P2_Lambda_A6-P1409 | 3753 | QSVLTQPASVSGSPGQSITISCTGTRSDVGRNNLVSWYQHHPGKAPKVMIYEGSKRPSGVSTRFSGSKSGNTASLTISGLQAEDEADYYCCSYAGSSTFEGVFGGGTKLTVL | 3754 | CSYAGSSTFEGV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_6mo_P2_IGG_A8-P1369 | 3755 | EVQLVQSGAEVKKAGESLKISCNSSGYSFTNYWIAWVRQVPGKGLEWMGIIYLGDSDTRYSPSFQGRVTISADKSISAAYLHWSSLKASDTAIYYCARGGPPGGVKLELTDFWGQGTLVTVSS | 3756 | ARGGPPGGVKLELTDF | COV107_6mo_P2_Lambda_A8-P1409 | 3757 | QSVLTQPPSASGTPGQRVTISCSGSNSNIGDNTVHWYQQLPGTAPKLLIFNNNQRPSGVPDRFSGSKSGTSASLAISGLQSDDEADYYCAAWDDSLDGPVVFGGGTKLTVL | 3758 | AAWDDSLDGPVV | LAMBDA |
| COV107_6mo_P2_IGG_B12-P1369 | 3759 | QVQLVQSGAEVKKPGASVKVSCKASGYTFTGFFIHWVRQAPGQGLEWMGWINPISGGTNYAQKFQGRVTVTRDTSITTVYVEVSSLRSDDTAVYYCARSNDIVAASTFYFHFWGQGTLVTVSS | 3760 | ARSNDIVAASTFYFHF | COV107_6mo_P2_Lambda_B12-P1409 | 3761 | SYVLTQPPSVSVAPGKTARITCGGKNFGSKSVHWYQQKPGQAPVLVIYYDTDRPSGIPERFSGSNSGNTATLTISGVEAGDEADYYCQVWYSSSDGVFGGGTKLTVL | 3762 | QVWYSSSDGV | LAMBDA |
| COV107_6mo_P2_IGG_B1-P1369 | 3763 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARELTHDVTPYFDYWGQGTLVTVSS | 3764 | ARELTHDVTPYFDY | COV107_6mo_P2_Lambda_B1-P1409 | 3765 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWGVFGGGTKLTVL | 3766 | QSYDSSLSGWGV | LAMBDA |
| COV107_6mo_P2_IGG_B3-P1369 | 3767 | EVQLVQSGAEVKKPGESLRISCKGSGYSFSSYWITWVRQRPGKGLEWMGKIDPSDSYLNYSPSFQGHVTISADKSTRTAYLQWSSLKASDTAMYYCARHWGRFGEGDYWGQGTLVTVSS | 3768 | ARHWGRFGEGDY | COV107_6mo_P2_Lambda_B3-P1409 | 3769 | QSVLTQPPSVSGAPGQKVTISCTGSSGAGYNLHWYQQLPGAAPKLLIDANGNRPSGVPDRFSGSKSGTSASLAITGLQAEDEADYYCQSYDSSLVPSWVFGGGTKLTVL | 3770 | QSYDSSLVPSWV | LAMBDA |
| COV107_6mo_P2_IGG_B5-P1369 | 3771 | QVQLQESGPGLVKPSETLSLTCTVSGGSVINGSYYWSWIRQPPGKGLEWIGFVYYSGSTNYNPSLKSRVTISVDTSKNQFSLNLNSVTAADTAVYYCATGSKSSYYFDYWGQGTLVTVSS | 3772 | ATGSKSSYYFDY | COV107_6mo_P2_Lambda_B5-P1409 | 3773 | QSVLTQPPSVSAAPGQKVTISCSGSSSNIGNNYVSWYQQLPGAAPKLLIYENNMRPSGIPDRFSGSKSGTSATLGITGLQTGDEADYYCGTWDSSLSVPYVFGTGTRVTVL | 3774 | GTWDSSLSVPYV | LAMBDA |
| COV107_6mo_P2_IGG_B6-P1369 | 3775 | QVQLVESGGGVVQPGRSLRLSCVASGFTFSYFDMHWVRQAPGKGLEWVALISHDGSTTFYGDSARGRFTISRDNSRNTLDLQMNSLRPEDTAVYFCAKPVDAAMFDFWGQGTLVTVS | 3776 | AKPVDAAMFDF | COV107_6mo_P2_Lambda_B6-P1409 | 3777 | SYVLTQPPSVSVAPGKTARITCGGNNIGSKSVHWYQQRPGQAPVLVIYYDSDRPSGIPERFSGSNSGNTATLTISRVEAGDEADFYCQVWDRSTNHLVVFGGGTQLTVL | 3778 | QVWDRSTNHLVV | LAMBDA |
| COV107_6mo_P2_IGG_B7-P1369 | 3779 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGSAWEIDYWGQGTLVTVSS | 3780 | ARRGSAWEIDY | COV107_6mo_P2_Lambda_B7-P1409 | 3781 | QSVLTQPPSASGTPGQRVTISCSGSTSNIGSNTVNWYQQLPGTAPKLLIYNNNQRPSGVPDRMSGSKSGTSASLAISGLQSEDEADYYCAAWDDSLNGYVFGTGTKVTVL | 3782 | AAWDDSLNGYV | LAMBDA |
| COV107_6mo_P2_IGG_B8-P1369 | 3783 | QVQLVQSGAEVKKPGASVKVSCRASGYTFPNYDLNWVRQATGQGLEWMGWMNPNSGNTGYAQKFQGRITMTRITSISTAYMELSSLRSEDTAVYYCARGRANWNSNFLLDSWGQGTLVTVSS | 3784 | ARGRANWNSNFLLDS | COV107_6mo_P2_Lambda_B8-P1409 | 3785 | QSVLTQPASVSGSPGQSITISCTGTSSDVGGYNLVSWYQQYPGNVPKLMIYEDAKRPSGVSNRFSGSKSANTASLTISGLQAEDEADYYCCSYAGSSTRYVFGTGTKVTVL | 3786 | CSYAGSSTRYV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_6mo_P2_IGG_C11-P1369 | 3787 | QVQLVQSGAEVKKPGASVKVSCKASGYIFTGYYMHWVRQAPGQGLEWIGWINPNSGGTNSTQKFQGRVTMTRDKSISTVYMELSRLRSDDTAVYYCARDLAFSMVRGVFDHWGQGTLVTVSS | 3788 | ARDLAFSMVRGVFDH | COV107_6mo_P2_Lambda_C11-P1409 | 3789 | QSVLTQPASVSGSPGQSITISCTGTSSDVGSYNLVSWYQQHPGKAPKLMIYEGSKWPSGVSNRFSGSKSGNTASLTISGLQAEDEADYYCCSYAGSNSWVFGGGTKLTVL | 3790 | CSYAGSNSWV | LAMBDA |
| COV107_6mo_P2_IGG_C1-P1369 | 3791 | QVQLVQSGAEVKKPGASVKVSCEASGYTLSTYDINWVRQATGQGLEWMGWMKPSSGHTGYAQKFQGRVTMTRNTSISTAYMELSGLRSEDTAVYYCVRNIGGYGFGGGYNWFDPWGQGTLVTVS | 3792 | VRNIGGYGFGGGYNWFDP | COV107_6mo_P2_Lambda_C1-P1409 | 3793 | QSVLTQPPSVSAAPGQKVTISCSGSSSNIENNYVSWYQQLPGTAPQLLIYDNNKRPSGIPGRFSGSKSGTSATLGITGLQTGDEAEYYCGTWDRSLSAYVFGTGTKVTVL | 3794 | GTWDRSLSAYV | LAMBDA |
| COV107_6mo_P2_IGG_C5-P1369 | 3795 | QLQLQESGPGLVKPSETLSLTCTVSGGSISTSSYFWGWIRQPPEKGLEWIGSIYSSGSTYYNPSLKSRLTISVDTSKNQLSLKLSSVTAADTAVYYCARLHQPPEGDWFDPWGQGTLVTVSS | 3796 | ARLHQPPEGDWFDP | COV107_6mo_P2_Lambda_C5-P1409 | 3797 | SYVLTQPPSVSVAPGKTASITCGGNDIGSKSVHWYQQKPGQAPVLVIYYDSDRPSGIPERFSGSNSGNTATLTISRVEGGDEADYYCQVWDSTSDRPLYVFGTGTKVTVL | 3798 | QVWDSTSD | LAMBDA |
| COV107_6mo_P2_IGG_C6-P1369 | 3799 | EVQLVQSGAEVKKPGESLKISCRGSGYSFTNYWIGWVRQMPGKGLEWMGIIYPGDSDTRYNPSFQGQVTISADKSISTAYLQWSSLKASDTAMYYCATRGSGNLIFDYWGQGTLVTVSS | 3800 | ATRGSGNLIFDY | COV107_6mo_P2_Lambda_C6-P1409 | 3801 | QSVLTQPASVSGSPGQSITISCTGTSSDVGSYNLVSWYQQYPGKAPKLMIYEGSKRPSGISNRFSGSNSGNTASLTISGLQPEDEADYYCCSYAGSTTLWVFGGGTKLTVL | 3802 | CSYAGSTTLWV | LAMBDA |
| COV107_6mo_P2_IGG_C7-P1369 | 3803 | QVQLQESGPGLVKPSETLSLTCTVSGGSVSGGSFYWSWIRRPPGKGLEWIGYIHYSGSANHNPSLKSRVSMSVDTSKNQFSLKLSSVTAADTAVYFCARGLYYYDSGGYLGGDFDSWGQGTLVTVSS | 3804 | ARGLYYYDSGGYLGGDFDS | COV107_6mo_P2_Lambda_C7-P1409 | 3805 | QSVLTQSPSASASLGASVTLTCTLSSGYSNYNVDWYQQRPGTGPRFVMRVGTGGIVGSKGYGIPDRFSVLGSGLNRYLTIKNIQEEDESDYHCGADHGSGSNFVVVFGGGTRLTVL | 3806 | GADHGSGSNFVVV | LAMBDA |
| COV107_6mo_P2_IGG_C8-P1369 | 3807 | EVQLVESGGGLVQPGRSLRLSCVASGFTFEDYAMHWVRQVPGKGLEWVSGMSWNSGTIGYADSVKGRFIISRDNAQNSLYLQMRNLRIEDTALYYCAKIPSASYDFGSGHDVFDIWGQGTMVTVSS | 3808 | AKIPSASYDFGSGHDVFDI | COV107_6mo_P2_Lambda_C8-P1409 | 3809 | QSVLTQPPSSSGTPGQRVTISCSGSSSNIGSSYVYWFQQLPGTAPKLLIYRNNQRPVPDRFSGSKSGTSASLAISGLRSEDEADYYCAAWYDSLSGVVFGGGTKLTVL | 3810 | AAWYDSLSGVV | LAMBDA |
| COV107_6mo_P2_IGG_D7-P1369 | 3811 | QVQLVESGGGVVQPGRSLRLSCAASGFTFSNYGMHLVRQAPGKGLEWVAIISYDGSNKYYADSVKGRFTISRDSSKNTLYLQMNNLRAEDTAVYYCAKDPLPFRDYYYYYMDVWGKGTTVTVS | 2812 | AKDPLPFRDYYYYYMDV | COV107_6mo_P2_Lambda_D7-P1409 | 3813 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLGVFGTGTKVTVL | 3814 | SSYTSSSTLGV | LAMBDA |
| COV107_6mo_P2_IGG_E11-P1369 | 3815 | QVQLQESGPGLVKPSQTLSLTCTVSGGSINNGSYYWTWIRQHPGKGLEWIGYIYYTGDTYYNPPLMSRLTVSVDTSKNQLSLKLSSVTAADTAVYYCASLIRAHTFGGVIVNPYFDYWGQGILVTVSS | 3816 | ASLIRAHTFGGVIVNPYFDY | COV107_6mo_P2_Lambda_E11-P1409 | 3817 | QSVLTQPPAASGTPGQRVTISCSGSSSNIGRNYVYWYQQLPGMAPKLLIYRNNQRPSGVPDRFSGSKSGPSASLAISGLRSEDEAAYYCAAWDDSLSGVLFGGGTNLAVL | 3818 | AAWDDSLSGVL | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_6mo_P2_IGG_E4-P1369 | 3819 | QVQLVESGGGVVQPGRSLRLSCAASGFSFSRYPMSWVRQAPGKGLEWVAVISNDGSNKDYADSVKGRFTVSRDNSKNTVYLQMNSLRPEDTAVFYCAREAPGVVPKLFDSWGQGTLVTVSS | 3820 | AREAPGVVPKLFDS | COV107_6mo_P2_Lambda_E4-P1409 | 3821 | SYVLTQPPSVSVAPGRTARITCGGNNIGSKSVHWYQQKPGQAPVLVIYYDSDRPSGIPERFSGSNSGNTATLTISRVEAGDEADYSCQVWDSSADHPVFGGGTKLTVL | 3822 | QVWDSSADHPV | LAMBDA |
| COV107_6mo_P2_IGG_E6-P1369 | 3823 | QVQLVESGGGVVQPGRSLRLSCAASGFSFSTYGMHWVRQAPGKGLEWVAVISFDGSQKYYGDSVKGRFTISRDNPKNTLDLQMNSLRAEDTAVYYCAKVVVRGVIISLYYGMDVWGQGTTVTVSS | 3824 | AKVVVRGVIISLYYGMDV | COV107_6mo_P2_Lambda_E6-P1409 | 3825 | SYVLTQPPSVSVSPGQTASITCSGDKLGDKSACWYQQKPGQSPVLVIYQDNKRPSGISGSNSGNTATLTISGTQAMDEADYYCQAWDSSTAVFGGGTKLTVL | 3826 | QAWDSSTAV | LAMBDA |
| COV107_6mo_P2_IGG_E7-P1369 | 3827 | EVQLVQSGAEVKKPGESLKISCQGSGYSFISYWIGWVRHMPGKGLEWMGVIHPGDSDTRYSPSFQGQVTISADKSITTAYLQWSSLKASDTATYYCARLSSVTMGWFDPWGQGTLVSVTT | 3828 | ARLSSVTMGWFDP | COV107_6mo_P2_Lambda_E7-P1409 | 3829 | QSVLTQPPSASGPPGQRVTISCSGSSSNIGSNSVSWYHHLPGTAPKLLIFNNNQRPSGVPDRVSGSKSGTSASLAISGLQSEDEADYYCAAWDDSLDGVVFGGGTKLTVL | 3830 | AAWDDSLDGVV | LAMBDA |
| COV107_6mo_P2_IGG_E8-P1369 | 3831 | EVQLLESGGGLVQPGGSLRLSCAASGFTFPIFAMSWVRQAPGKGLKWVSGISGSEGTTYSADSVKGRFTISRDNSKNTLYLQMNSLRAEDTATYYCAKHPDGYISGWYLFWGQGTLVTVSS | 3832 | AKHPDGYISGWYLF | COV107_6mo_P2_Lambda_E8-P1409 | 3833 | SYVLTQPPSVSVVPGQTARITCGGNNIGGKSVNWYQQKPGQAPVLVIYYDGDRPSGIPERFSGSNSGNTATLTISRVEAGDEADYYCQVWDASSDPMVFGGGTKVTV | 3834 | QVWDASSDPMV | LAMBDA |
| COV107_6mo_P2_IGG_F12-P1369 | 3835 | EVQLVESGGGLVKPGGSLRLSCAASGFTFSXYSMNWXRXVPGKGVEWVSSSSSSNSYIYEAXSLKXGFTXSRDNAKNSLYLQMNSLRAEDTAVYYCARDPAGYSYGQYYYYYMDVWGKGTTVTVSS | 3836 | ARDPAGYSYGQYYYYYMDV | COV107_6mo_P2_Lambda_F12-P1409 | 3837 | QSVLTQPASVSGSPGQSITISCTGTSSDVGAYNYVSWYQHHPGKAPKLMIFDVTNRPSGVSNRFSGSKSGNTASLTISGLQAEDEADYYCSSYTRSSPLYVFGTGTKVTVL | 3888 | SSYTRSSPLYV | LAMBDA |
| COV107_6mo_P2_IGG_F3-P1369 | 3839 | EVQLVESGGGLVQPGRSLRLSCAASGFTFDDYAMHWVRQAPGKGLEWVSGISWNSGTIGYADVKGRFTISRDNAKNSLSLQMNSLRYEDTALYYCAKDLGYDFRTSYNYYDYWGQGTLVTVSS | 3840 | AKDLGYDFRTSYNYYDY | COV107_6mo_P2_Lambda_F3-P1409 | 3841 | QSVLTQPPSVSGAPGQRVTISCTGSSSNIGAGYDVHWYQQLPGTAPKLLIYANNNRPSGVPDRFSGSKSGTSASLAITGLQAEDEADYYCQSYDSSLSQVFGTGTKVTVL | 3842 | QSYDSSLSQV | LAMBDA |
| COV107_6mo_P2_IGG_G9-P1369 | 3843 | QVQLVQSGAEIKKPGASVKVACKASGFTFSGYYIHWVRQAPGQGLEWMGWIIPDSGGANYAQKFQGRVTMTRDTSITTAYMELSSLRSDDTAMYYCARDDSTGYPNPNDAFDIWGQGTLVTVS | 3844 | ARDDSTGYPNPNDAFDI | COV107_6mo_P2_Lambda_G9-P1409 | 3845 | QSVLTQPPSVSAAPGQKVTVSCSGSNSNIGNNFVSWYQQLPGTAPKLLIYENNKRPSGIPDRFSGSKSGTSATLVITGLQTGDEADYYCGTWDSSLSVGWVFGGGTRLTVL | 3846 | GTWDSSLSVGWV | LAMBDA |
| COV107_6mo_P2_IGG_H2-P1369 | 3847 | QVQLQESGPGLVKSSQTLSLNCSVFGASISSGGYYWTWIRQHPGKGLEWIGYIHYRGTYYNPSLKSRVTMSVDTSKNQFSLKVRSVSAADTAIYYCARAIVVVTLNWFDLWGQGTLVTVSS | 3848 | ARAIVVVTLNWFDL | COV107_6mo_P2_Lambda_H2-P1409 | 3849 | NFMLTQPHSVSESPGKTVTISCSGSGGSIASNYVQWYQQRPGSAPTAVIYEDNQRPSGVPDRFSGSIDSSSNSASLTISGLKTEDEADYYCQSYDTSNPVIFGGGTKLTV | 3850 | QSYDTSNPVI | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_Plate1_HC_13-P1369 | 3851 | QVQLVQSGAEVKKPGASVKVSCKASGYTFTDYYIHWVRQAPGQGLEWMGWINPNSGGTNYAQKFQGRVTMTRDTSISTAYMELSRLRSDDTAVYYCARDVIVSMVRGVIFRMDVWGQGTTVTVSS | 3852 | ARDVIVSMVRGVIFRMDV | COV107_Plate1_Lambda_13-P1409 | 3853 | QSVLTQPPSASGTPGQRVTISCSGSSSNIGSNTVNWYQQLPGTAPKLLIYSNNQRPSGVPDRFSVSKSGTSASLAISGLQSEDEADYYCAAWDDSLNGVVFGGGTKLTVL | 3854 | AAWDDSLNGVV | LAMBDA |
| COV107_Plate1_HC_22-P1369 | 3855 | QVQLVESGGGVVQPGRSLRLSCAASGFTFSSHAMHWVRQAPGKGLEWVAVISYDGSNKYYADSVKGRFTISRDNSKNTLYLQMNSLRAEDTAVYYCAREDYYDSSGSFDYWGQGTLVTVSS | 3856 | AREDYYDSSGSFDY | COV107_Plate1_Lambda_22-P1409 | 3857 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL | 3858 | SSYTSSSTWV | LAMBDA |
| COV107_Plate1_HC_25-P1369 | 3859 | QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAGGTNPQWLDSTFDYWGQGTLVTVSS | 3860 | AGGTNPQWLDSTFDY | COV107_Plate1_Lambda_25-P1409 | 3861 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTYVFGTGTKVTVL | 3862 | SSYTSSSTYV | LAMBDA |
| COV107_Plate1_HC_26-P1369 | 3863 | EVQLVQSGAEVKKPGESLKISCKGSGYSFISYWIGWVRQMPGKGLEWMGIIYPGDSDTRYSPSFQGQVTISADKSISTAYLQWSSLKASDTAMYYCARRPSSYSGWFDPWGQGTLVTVSS | 3864 | ARRPSSYSGWFDP | COV107_Plate1_Lambda_26-P1409 | 3865 | QSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLNGLVFGGGTKLTVL | 3866 | AAWDDSLNGLV | LAMBDA |
| COV107_Plate1_HC_27-P1369 | 3867 | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCATAHPRRIQGVFFLGPGVWGQGTTVTVSS | 3868 | ATAHPRRIQGVFFLGPGV | COV107_Plate1_Lambda_27-P1409 | 3869 | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVL | 3870 | AAWDDSLNGVV | LAMBDA |
| COV107_Plate1_HC_28-P1369 | 3871 | QVQLVQSGAEVKKPGSSVKVSCKASGGTFRSYAISWVRQAPGQGLEWMGGIIPIFGTTNYAQKFQGRVTITADESTSRAYMELSSLRSEDTAVYYCARDSSGYYYVSNWFDPWGQGTLVTVSS | 3872 | ARDSSGYYYVSNWFDP | COV107_Plate1_Lambda_28-P1409 | 3873 | QSVLTQPPSVSGAPGQRVTISCTGSSSNIGAGYDVHWYQQLPGTAPNLLIYDNINRPSGVPDRFSGSKSGTSASLAITGLQAEDEADYYCQSYDSSLSGVVFGGGTKLTVL | 3874 | QSYDSSLSGVV | LAMBDA |
| COV107_Plate1_HC_29-P1369 | 3875 | EVQLVESGGGLIQPGGSLRLSCAASGFTVSSNYMSWVRQAPGKGLEWVSVIYSGGSTYYADSVKGRFTISRDNSKNTLYLQMHSLRAEDTAVYYCARGEGWDLPYDYWGQGTLVTVSS | 3876 | ARGEGWDLPYDY | COV107_Plate1_Lambda_29-P1409 | 3877 | QSALTQPPSASGSPGQSVTISCTGTSSDVGGYNYVSWYQQHPGKAPKLMIYEVSK38RPSGVPDRFSGSKSGNTASLTVSGLQAEDEADYYCSSYAGSNNFVVFGGGTKLTVL | 3888 | SSYAGSNNFVV | LAMBDA |
| COV107_Plate1_HC_32-P1369 | 3879 | EVQLVESGGGLVQPGGSLRLSCADSGFTFSSYWMSWVRQAPGKGLEWVANIKQDGSEKYYVDSVKGRFTISRDNAKNSLYLQMNSLRAEDTAVYYCAVQLWLRGNFDYWGQGTLVTVSS | 3880 | AVQLWLRGNFDY | COV107_Plate1_Lambda_32-P1409 | 3881 | NFMLTQPHSVSESPGKTVTISCTGSSGSIASNYVQWYQQRPGSAPTTVIYEDNQRPSGVPDRFSGSIDSSSNSASLAISGLKTEDEADYYCQSYDSSNHVVFGGGTKLTVL | 3882 | QSYDSSNHVV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_Plate1_HC_35-P1369 | 3883 | EVQLVESGGGLIQPGGSLRLSCAASGFTVSSNYMSWVRQAPGKGLEWVSVIYTGGSTFYADSVKGRFTISRDNSKNTLYLQMNSLRAEDTAMYYCARGEGWDLPYDYWGQGTLVTVSS | 3884 | ARGEGWDLPYDY | COV107_Plate1_Lambda_35-P1409 | 3885 | QSVLTQPPSASGSPGQSVTISCTGTSSDVGGYNYVSWYQQHPGKAPKLMIYEVRKRPSGVPDRFSGSKSGNTASLTVSGLQAEDEADYYCSSYAGSNNFVLFGGGTKLTVL | 3886 | SSYAGSNNFVL | LAMBDA |
| COV107_Plate1_HC_41-P1369 | 3887 | EVQLVESGGGLVQPGGSLRLSCAASGFTFSSYYMNWVRQAPGKGLEWVSYISSSSSTIYYADSVKGRFTISRDNAKNSLYLQMNSLRDEDTAVYYCARDPQRDPADYFDYWGQGTLVTVSS | 3888 | ARDPQRDPADYFDY | COV107_Plate1_Lambda_41-P1409 | 3889 | SYVLTQPPSVSVAPGKTARITCGGNNIGSKSVHWYQQKPGQAPVLVIYYDSDRPSGIPERFSGSNSGNTATLTISRVEAGDEADYYCQVWDSSRVFGGGTKLTVL | 3890 | QVWDSSRV | LAMBDA |
| COV107_Plate1_HC_46-P1369 | 3891 | QVQLQESGPGLVKPSGTLSLTCAVSGGSISSTNWWSWVRQPPGKGLEWIGEIYHTGSTNYNPSLKSRVTISVDKSKNQFSLKLSSVTAADTAVYYCVRDGGRPGDAFDIWGQGTMVTVSS | 3892 | VRDGGRPGDAFDI | COV107_Plate1_Lambda_46-P1409 | 3893 | QSALTQPASVSGSPGQSITISCTGTSSDVGGYNFVSWYQQHPGKAPKLMIYDVSNRPSGVSNRFSGSKSGNTASLTISGLQAEDEADYYCNSYTSSSTRVFGTGTKVTVL | 3894 | NSYTSSSTRV | LAMBDA |
| COV107_Plate1_HC_48-P1369 | 3895 | QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCATRGGYYDSSGYYALAFDIWGQGTMVTVSS | 3896 | ATRGGYYDSSGYYALAFDI | COV107_Plate1_Lambda_48-P1409 | 3897 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTVWVFGGGTKLTVL | 3898 | SSYTSSSTVWV | LAMBDA |
| COV107_Plate1_HC_49-P1369 | 3899 | EVQLLESGGGLVQPGGSLRLSCAASGFTFSSYAMSWVRQAPGKGLEWVSGISDSGGSTYYADSVKGRFTISRDNSKNTLYLQMNSLRAEDTAVYYCAKEEVLPAVEYFQHWGQGTLVTVSS | 3900 | AKEEVLPAVEYFQH | COV107_Plate1_Lambda_49-P1409 | 3901 | SYVLTQPPSVSVAPGKTARITCGGNNIGSKSVHWYQQKPGQAPVLVISYDSDRPSGIPERFSGSNSGNTATLTISRVEAGDAADYYCQVWDGSSDHHVVFGGGTKLTVL | 3902 | QVWDGSSDHHVV | LAMBDA |
| COV107_Plate1_HC_52-P1369 | 3903 | QVQLVQSGAEVKKPGASVKVSCKASGYTFTSYGFSWVRQAPGQGLEWLGWISAYNGNTNYAQKLQGRVTMTTDTSTSTAYMELRSLRSDDTAVYYCARAIAVAGTSGEFDYWGQGTLVTVSS | 3904 | ARAIAVAGTSGEFDY | COV107_Plate1_Lambda_52-P1409 | 3905 | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGHVVFGGGTKLTVL | 3906 | AAWDDSLNGHVV | LAMBDA |
| COV107_Plate1_HC_58-P1369 | 3907 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSQGWLQLNDYVVGQGTLVTVSS | 3908 | ARSQGWLQLNDY | COV107_Plate1_Lambda_58-P1409 | 3909 | NFMLTQPHSVSESPGKTVTISCTGSSGSIASNYVQWYQQRPGSAPTTMIYEDNQRPSGVPDRFSGSIDSSSNSASLTISGLKTEDEADYYCQSYDSSTPNCVFGGGTKLTVL | 3910 | QSYDSSTPNCV | LAMBDA |
| COV107_Plate1_HC_5-P1369 | 3911 | QVQLVQSGAEVKKPGASVKVSCKASGYTFTGYSMHWVRQAPGQGLEWMGWINPNSGGTNYAQKFQGRVTMTRDTSISTAYMELNRLRSDDTAVYYCARELIAVAGIFDYWGQGTLVTVSS | 3912 | ARELIAVAGIFDY | COV107_Plate1_Lambda_5-P1409 | 3913 | SYVLTQPPSVSVAPGKTARITCGGNNIGSKNVHWYQQKPGQAPVLVIYYDSDRPIPERFSGSNSGNTATLTISRVEAGDEADYYCQVWDSSWVFGGGTKLTVL | 3914 | QVWDSSWV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_Plate1_HC_60-P1369 | 3915 | QVQLVQSGAEVKKPGASVMLSCKASGYTFTGYYMHWVRQAPGQGLEWMGWINPNSGGTNYAQKFQGRVTMTRDTSITTTYMELSRLRSDDTAVYYCARDLAFSMVRAPGDYWGQGTLVTVSS | 3916 | ARDLAFSMVRAPGDY | COV107_Plate1_Lambda_60-P1409 | 3917 | QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVL | 3918 | CSYAGSSTWV | LAMBDA |
| COV107_Plate1_HC_62-P1369 | 3919 | EVQLVESGGGLIQPGGSLKLSCVVSGFTVSKNYISWVRQAPGKGLEWVSVIFAGGSTFYADSVKGRFAISRDNSNNTLFLQMNSLRVEDTAIYYCARGDGELFFDHWGQGTLVTVSS | 3920 | ARGDGELFFDH | COV107_Plate1_Lambda_62-P1409 | 3921 | QSVLTQPPSVSGAPGQRVTISCTGTSSNIGAGYDVHWYQQLPGRAPKVLISGNNIRPSEVPDRFSGSRSGTSASLAITSLQPEDEAQYYCQSYDSSLYAVFGGGTKLTVL | 3922 | QSYDSSLY | LAMBDA |
| COV107_Plate1_HC_63-P1369 | 3923 | QVQLVQSGAEVKKPGASVRVSCKASGYTFTSYGFSWVRQAPGQGLEWMGWISAYNGNTNFAQKLQGRVTMTTDTSTSTAYMELRSLRSDDTAVYYCARGEAVAGTTGFFDYWGQGTLVTVSS | 3924 | ARGEAVAGTTGFFDY | COV107_Plate1_Lambda_63-P1409 | 2925 | QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGFVVFGGGTKLTVL | 2926 | QQWDDSLSGFVV | LAMBDA |
| COV107_Plate1_HC_64-P1369 | 3927 | QLQLQESGPGLVKPSETLSLTCTVSGGSISSSSHYWGWIRQPPGKGLEWIGTIYYSGSTYYNPSLKSRVTISVDTSKNQFSLRLSSVTAADTAVYYCASAPYLNWNDWIFDYWGQGTLVTVSS | 3928 | ASAPYLNWNDWIFDY | COV107_Plate1_Lambda_64-P1409 | 3929 | QSVLTQPASVSGSPGQSITISCTGTSSDVGGYNYVSWYQQHPGEAPKLMIHDVSNRPSGVSNRFSGSKSGNTASLTISGLQAEDEADYYCSSYTSSSTLVFGGGTKLTVL | 3930 | SSYTSSSTLV | LAMBDA |
| COV107_Plate1_HC_68-P1369 | 3931 | QVQLVQSGAEVKKPGASVRVSCKASGYTFTSYGFSWVRQAPGQGLEWMGWISAYNGNTNFAQKLQGRVTMTTDTSTSTAYMELRSLRSDDTAVYYCARGEAVAGTTGFFDYWGQGTLVTVSS | 3932 | ARGEAVAGTTGFFDY | COV107_Plate1_Lambda_68-P1409 | 3933 | QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGFVVFGGGTKLTVL | 3934 | QQWDDSLSGFVV | LAMBDA |
| COV107_Plate1_HC_73-P1369 | 3935 | EVQLVESGGGLIQPGGSLKLSCVVSGFTVSKNYISWVRQAPGKGLEWVSVIFAGGSTFYADSVKGRFAISRDNSNNTLFLQMNSLRVEDTAIYYCARGDGELFFDQWGQGTLVTVSS | 3936 | ARGDGELFFDQ | COV107_Plate1_Lambda_73-P1409 | 3937 | QSVLTQPPSVSGAPGQRVTISCTGTSSNIGAGYDVHWYQQLPGRAPKVLISGNNIRPSEVPDRFSGSRSGTSASLAITSLQPEDEAQYYCQSYDSSLYAVFGGGTKLTVL | 3938 | QSYDSSLYAV | LAMBDA |
| COV107_Plate1_HC_77-P1369 | 3939 | QVQLQESGPGLVKPSETLSLTCTVSGASVSSGSYYWSWIRQPPGKGLEWIGYIYYSGSTNYNPSLKSRVTISVDTSKNQFSLKLSSVTAADTAVYYCARERPGGTYSNTWYTPTDTNWFDTWGQGTLVTVSS | 3940 | ARERPGGTYSNTWYTPTDTNWFDT | COV107_Plate1_Lambda_77-P1409 | 3941 | SYVLTQPPSVSVAPGKTARITCGGNNIGSKSVHWYQQKPGQAPVLVIYFDSDRPSGIPERFSGSNSGNTATLTISRVEAGDEADYYCQVVVDSSRDHVVFGGGTKLTVL | 3942 | QVWDSSRDHVV | LAMBDA |
| COV107_Plate1_HC_79-P1369 | 3943 | QVQLVQSGAEVKKPGASVKVSCKASGYTFTSYYMHWVRQAPGQGLEWMGIINPSGGSTSYAQKLQGRVTMTRDTSTSTVYMELSSLRSEDTAVYYCARANHETTMDTYYYYYYMDVVVGKGTTVTVSS | 3944 | ARANHETTMDTYYYYYMDV | COV107_Plate1_Lambda_79-P1409 | 3945 | QSVLTQPASVSGSPGQSITISCTGTSSDVGGYKYVSWYQRHPGKAPKLMIYDVSNRPSGVSNRFSGSKSGNTASLTISGLQAEDEADYYCSSYTSSSTSVVFGGGTQLTVL | 3946 | SSYTSSSTSVV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_Plate1_HC_83-P1369 | 3947 | QVQLVQSGAEVKKPGASVKVSCKASGYILTDYFIHWVRQAPGQGLEWMGWINPNSGGTNYAQKFQGRVTMTRDTSISTAYMELSRLRSDDTAVYHCARYKGTTVNTNYYYGMDVWGQGTTVTVSS | 3948 | ARYKGTTVNTNYYYGMDV | COV107_Plate1_Lambda_83-P1409 | 3949 | SYVLTQPPSVSVSPGQTASITCSGDKLGDKYACWYQQKAGQSPVLVIYQDSKRPSGIPERFSGSKSGNTATLTISGTQAMDEADYYCQAWDSSTVVFGGGTKLTVL | 3950 | QAWDSSTVV | LAMBDA |
| COV107_Plate1_HC_91-P1369 | 3951 | QVQLVQSGAEVKKPGASVKVSCKASGYTFTSYYMHWVRQAPGQGLEWMGIINPSGGSTSYAQKLQGRVTMTRDTSTSTVYMELSSLRSEDTAVYYCARANHETTMDTYYYYYYMDVWGKGTTVTVSS | 3952 | ARANHETTMDTYYYYYYMDV | COV107_Plate1_Lambda_91-P1409 | 3953 | QSALTQPASVSGSPGQSITISCTGTSSDVGGYKYVSWYQRHPGKAPKLMIYDVSNRPSGVSNRFSGSKSGNTASLTISGLQAEDEADYYCSSYTSSSTSVVFGGGTQLTVL | 3954 | SSYTSSSTSVV | LAMBDA |
| COV107_Plate1_HC_92-P1369 | 3955 | EVQLVQSGAEVKKPGESLKISCKGSGYSFTSYWIGWVRQMPGKGLEWMGILYPGDSDTTYSPSFQGQVTISADKSISTAYLQWSSLKASDTAMYYCARLHPTYYDILTGYYIDYWGQGTLVTVSS | 3956 | ARLHPTYYDILTGYYIDY | COV107_Plate1_Lambda_92-P1409 | 3957 | QSALTQPASVSGSPGQSITISCTGTSSDVGSYNLVSWYQQHPGKAPKLMIYEGPSGVSNRFSGSKSGNTASLTISGLQAEDEADYYCCLYAFSSIVFGGGTKLTVL | 3958 | CLYAFSSIV | LAMBDA |
| COV107_Plate2_HC_10-P1369 | 3959 | QVQLQESGPGLVKPSETLSLTCTVSGGSISNYYWSWIRQPPGKGLEWIGYIYYSGSTNYNPSLKSRVTISVDTSKNQFSLKLTSVTAADTAVYYCARILRGVAENWFDPWGQGTLVTVSS | 3960 | ARILRGVAENWFDP | COV107_Plate2_lambda_10-P1409 | 3961 | SYVLTQPPSVSVAPGKTARITCGGNNIGSKSVHWYQQKPGQAPVLVIYYDTDRPSGIPERFSGSNSGNTATLTISRVEAGDEADYYCQVWDNNSDHRGVFGGGTRLTVL | 3962 | QVWDNNSDHRGV | LAMBDA |
| COV107_Plate2_HC_1-P1369 | 3963 | EVQLVQSGAEVKKPGESLKISCKGSGYRFTSYWIAWVRQMPGKGLEWMGIIYPGDSDTRYSPSFQGQVTISADQSISTAYLQWSSLKASDTAMYYCARGGPPGGVKLELTDYWGQGALVTVSS | 3964 | ARGGPPGGVKLELTDY | COV107_Plate2_lambda_1-P1409 | 3965 | QSVLTQPPSASGTPGQRVTISCSGSSSNIGSNTVNWYQQLPGTAPQLLIYNNYQRPSGVPDRFSGSKSGTSASLAISGLQSEDEADYYCAAWDDSLNGPVVFGGGTKLTVL | 3966 | AAWDDSLNGPVV | LAMBDA |
| COV107_Plate2_HC_20-P1369 | 3967 | QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAGMYYDILTGYSEGAFDIWGQGTMVTVSS | 3968 | AGMYYDILTGYSEGAFDI | COV107_Plate2_lambda_20-P1409 | 3969 | QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVL | 3970 | CSYAGSSTWV | LAMBDA |
| COV107_Plate2_HC_22-P1369 | 3971 | QVQLVESGGGVVQPGRSLRLSCAASGFTFSSYGMHWVRQAPGKGLEWVAVISYDGSNKYYADSVKGRFTISRDNSKNTLDLQMNSLRAEDTAVYYCAKGGYYYYNSDSYQAEIDYWGQGTLVTVS | 3972 | AKGGYYYYNSDSYQAEIDY | COV107_Plate2_lambda_22-P1409 | 3973 | QSVLTQPPSVSAAPGQRVTISCSGSSSNIGNNYVSWYQQLPGTAPKLLIYENNKRPSGIPDRFSGSKSGTSATLGITGLQTGDEADYYCGTWDSSLSAFVFGTGTKVTVL | 3974 | GTWDSSLSAFV | LAMBDA |
| COV107_Plate2_HC_24-P1369 | 3975 | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDFYHNWFDPWGQGTLVTVSS | 3976 | ARDFYHNWFDP | COV107_Plate2_lambda_24-P1409 | 3977 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQWVVFGGGTKLTVL | 3978 | QSYDSSNQWVV | LAMBDA |

TABLE 9-continued

Sequence pairs of antibody heavy and light chain variable regions from six individuals at 1.3 and 6.2 month time points.

| | | | | | | | | | |
|---|---|---|---|---|---|---|---|---|---|
| COV107_Plate2_HC_25-P1369 | 3979 | EVQLVESGGGLVQPGRSLRLSCAASGFTFDDYAMHWVRQAPGKGLEWVSGISWNSGSRGYADSVKGRFTISRDNAKNSLYLLMNSLRAEDTAFYYCAKDDREGFGDYFDYWGQGTLVTVSS | 3980 | AKDDREGFGDYFDY | COV107_Plate2_lambda_25-P1409 | 3981 | SYVLTQPPSVSVAPGKTARITCGGNNIGSKSVHWYQQKPGQAPVLVIYYDSVRPSGIPERFSGSNSGNTATLTISRVEAGDEADYYCQVVVDSSSDHYVFGTGTKVTVL | 3982 | QVWDSSSDHYV | LAMBDA |
| COV107_Plate2_HC_28-P1369 | 3983 | QVQLQESGPGLVKPSETLSLSCAVSGGSIGSYFWSWIRQPPGKGLEWIGYLHYSGSTNYNPSLKSRVTISVDTSKNQFSLKLSSVTAADTAVYYCARLQWLRGAFDIWGQGTMVTVSS | 3984 | ARLQWLRGAFDI | COV107_Plate2_lambda_28-P1409 | 3985 | NFMLTQPHSVSESPGKTVTISCTGSSGSIASNYVQWYQQRPGSAPTTVINEDNQRPSGVPDRFSGSIDSSSNSASLTISGLKTEDEADYYCQSYDSSNLVFGGGTKLTVL | 3986 | QSYDSSNLV | LAMBDA |
| COV107_Plate2_HC_2-P1369 | 3987 | QVQLQESGPRLVKPSENLSLTCTVSGGSISSYYWSWIRQPPGKGLEWIGYIYYTGSTKYNPSLKSRVTISVDTSKNQFSLKLSSVTAADTAVFYCARATTPFSGVDYWGQGTLVTVSS | 3988 | ARATTPFSGVDY | COV107_Plate2_lambda_2-P1409 | 3989 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDTSNWVFGGGTKLTVL | 3990 | QSYDTSNWV | LAMBDA |
| COV107_Plate2_HC_34-P1369 | 3991 | QVQLVESGGGVVQPGRSLRLSCAASGLTFSSYGMHWVRQAPGKGLEWVAVIWYDGINKYYADSVKGRFTISRDNSKNTLYLQMNSLRAEDTAVYYCARDRGLRLGGPKYYFDYWGQGTLVTVSS | 3992 | ARDRGLRLGGPKYYFDY | COV107_Plate2_lambda_34-P1409 | 3993 | QSVLTQPASVSGSPGQSITISCPGTSSDVGGYNYVSWYQQHPGKAPKLMIYDVSTRPSGVSNRFSGSKSGNTASLTISGLQAEDEADYYCSSYTSSSVVFGGGTKLTVL | 3994 | SSYTSSSVV | LAMBDA |
| COV107_Plate2_HC_35-P1369 | 3995 | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARETQGGYYGSGSYYASPFDPWGQGTLVT | 3996 | ARETQGGYYGSGSYYASPFDP | COV107_Plate2_lambda_35-P1409 | 3997 | SYVLTQPPSVSVAPGKTARITCGGNNIGSKSVHWYQQKPGQAPVLVIYYDSDRPSGIPERFSGSNSGNTATLTISRVEAGDEADYYCQVVVDSSSDHPVVFGGGTKLTVL | 3998 | QVWDSSSDHPVV | LAMBDA |
| COV107_Plate2_HC_36-P1369 | 3999 | QVQLQESGPGLVKPSETLSLTCTVSGGSISNYYWSWIRQPPGKGLEWIGYIYYSGSTNYNPSLKSRVTISVDTSKNQFSLKLSSVTAADTAVYYCARVEDWGYCSSTNCYSGAFDIWGQGTMVTVSS | 4000 | ARVEDWGYCSSTNCYSGAFDI | COV107_Plate2_lambda_36-P1409 | 4001 | QSVLTQPPSVSEAPRQRVTISCSGSSSNIGNNAVNWYQQLPGKAPKLLIYYDDLLPSGVSDRFSGSKSGTSASLAISGLQSEDEADYYFAAWDDSLNGAWVFGGGTKLTVL | 4002 | AAWDDSLNGAWV | LAMBDA |
| COV107_Plate2_HC_40-P1369 | 4003 | QVQLVQSGAEVKKPGASVKVSCKASGYSFTSYYMHWVRQAPGQGLEWMGIINPSGGSTSYAQKFQGRVTMTRDTSTSTVYMELSSLRSEDTAVYYCARDPSPIIARPGMGYWFDPWGQGTLVTVSS | 4004 | ARDPSPIIARPGMGYWFDP | COV107_Plate2_lambda_40-P1409 | 4005 | QSVLTQPPSVSGAPGQRVTISCTGSSSNIGAGYDVHWYQHLPGTAPKLLIYGNNNRPSGVPDRFSGSRSGTSASLAITGLQAEDEADYYCQSYDSSLSAVVFGGGTKLTVL | 4006 | QSYDSSLSAVV | LAMBDA |
| COV107_Plate2_HC_42-P1369 | 4007 | QVQLVESGGGLVQPGRSLRLSCAASGFTFSTYAMHWVRQAPGKGLKWVAVISYDGGNKYYADSVKGRFTISRDNSKNTLYLQMNSLRAEDTAVYYCARDPIWFGELLSPPFVHFDYWGQGTLVTVS | 4008 | ARDPIWFGELLSPPFVHFDY | COV107_Plate2_lambda_42-P1409 | 4009 | QSVLTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGGVYVFGTGTTVTV | 4010 | GTWDSSLSAGGVYV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_Plate2_HC_45-P1369 | 4011 | QVQLVQSGAEVKKPGASVKVSCKASGYTFTGYYMHWVRQAPGQGLEWMGWINPNSGGTKYAQKFQGRVTMTRDTSISTAYMELSRLRSDDTAVYYCARGHDYVWGSYRYHNVWGQGTLVTVSS | 4012 | ARGHDYVWGSYRYHNV | COV107_Plate2_lambda_45-P1409 | 4013 | QSVLTQPASVSGSPGQSITISCTGTSSDVGGYNYVSWYQQHPGKAPKVMIYDVSNRPSGVSNRFSGSKSGNTASLTISGLQAEDEADYYCSSYTSSSTLLFGGGTKLTXL | 4014 | SSYTSSSTLL | LAMBDA |
| COV107_Plate2_HC_46-P1369 | 4015 | EVQLVESGGGLVQPGGSLRLSCAASGFTFSSYWMSWVRQAPGKGLEWVANIKQDGSEKYYVDSVKGRFTISGDNAKNSLYLHMNSLRAEDTAVYYCAIQLWLRGGYDYWGQGTLVTVSS | 4016 | AIQLWLRGGYDY | COV107_Plate2_lambda_46-P1409 | 4017 | QSVLTQPPSASGSPGQSVTISCTGTSSDVGGYNYVSWYQQHPGKAPKLMIYEVTKRPSGVPDRFSGSKSGNTASLTVSGLQAEDEADYYCSSYAGSNNYVVFGGGTKLTV | 4018 | SSYAGSNNYVV | LAMBDA |
| COV107_Plate2_HC_47-P1369 | 4019 | EVQLVESGGGLVKPGGSLRVSCAASGFTFSSYSMNWVRQAPGKGLEWVSSISSSKNYIYYADSVKGRFTISRDNAKNSLYLQMNSLRAEDTAVYYCTRGSRGYYDRSGYYTPLDPYYGMDVWGQGTTVTVSS | 4020 | TRGSRGYYDRSGYYTPLDPYYGMDV | COV107_Plate2_lambda_47-P1409 | 4021 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKVTVL | 4022 | QSYDSSLSGSYV | LAMBDA |
| COV107_Plate2_HC_49-P1369 | 4023 | QVQLVESGGGVVQPGRSLRLSCAASGFTFSNYAMHWVRQAPGKGLEWVAVISYDGSNXYYADSVKGRFTISRDNSKNTLYLQMNSLRAEDTAIYYCASGYTGYDYFVRGDYYGLDVWGQGTTVTVSS | 4024 | ASGYTGYDYFVRGDYYGLDV | COV107_Plate2_lambda_49-P1409 | 4025 | QSVLTQSPSASASLGASVKLTCTLSSGHSSYAIAWHQQQPEKGPRYLMKLNTDGSHSKGDGIPDRFSGSSSGAERYLTISSLQSEDEADYYCQTWGTGILVFGGGTKLTVL | 4026 | QTWGTGILV | LAMBDA |
| COV107_Plate2_HC_4-P1369 | 4027 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGEGWELPYDYWGQGTLVTVSS | 4028 | ARGEGWELPYDY | COV107_Plate2_lambda_4-P1409 | 4029 | QSVLTQPPSASGSPGQSVTISCTGTSSDVGGYKYVSWYQQHPGKAPKLMIYEVSKRPSGVPDRFSGSKSGNTASLTVSGLQAEDEADYYCSSYEGSNNFVVFGGGTKLTV | 4030 | SSYEGSNNFVV | LAMBDA |
| COV107_Plate2_HC_54-P1369 | 4031 | EVQLVESGGGLVQPGRSLRLSCAASGFTFDDYAMHWVRQAPGKGLEWVSGISWNSGSIGYADSVKGRFTISRDNAKSSLYLQMKSLRVEDTALYYCAKDSLVRRNFYYYYMDVWGKGTTVTVSS | 4032 | AKDSLVRRNFYYYYMDV | COV107_Plate2_lambda_54-P1409 | 4033 | QSVLTQPPSVSGAPGQRVTISCTGSSSNIGAGYDVHWYQQLPGTAPKLLIYGNSDRGVPDRFSGSKSGTSASLAITGLQAEDEADYYCQSYDSSLSGVVFGGGTKLTXL | 4034 | QSYDSSLSGVV | LAMBDA |
| COV107_Plate2_HC_55-P1369 | 4035 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGQLLPFADYWGQGTLVTVSS | 4036 | ARGQLLPFADY | COV107_Plate2_lambda_55-P1409 | 4037 | NFMLTQPHSVSESPGKTVTISCAGSSGSIASNYVQWYQQRPGSAPTTVIYEDNQRPSGVPDRFSGSIDSSSNSASLTISGLK1EDEADYYCQSYDSSKSWVFGGGTKLTVL | 4038 | QSYDSSKSWV | LAMBDA |
| COV107_Plate2_HC_57-P1369 | 4039 | QVQLQESGPGLVKPSGTLSLTCAVSGGSISSTNWWSWVRQPPGKGLEWIGEIYHTGSTNYNPSLKSRVTISVDKSKNQFSLKLSSVTAADTAVYYCVRDGGRPGDAFDIWGQGTMVTVSS | 4040 | VRDGGRPGDAFDI | COV107_Plate2_lambda_57-P1409 | 4041 | QSVLTQPASVSGSPGQSITISCTGTSSDVGGYNYVSWYQQHPGKAPKLMIYDVSNRPSGVSNRFSGSKSGNTASLTISGLQAEDEADYYCNSYTSSSTRVFGTGTKVTVL | 4042 | NSYTSSSTRV | LAMBDA |

TABLE 9-continued

Sequence pairs of antibody heavy and light chain variable regions from six individuals at 1.3 and 6.2 month time points.

| | | | | | | | | | |
|---|---|---|---|---|---|---|---|---|---|
| COV107_Plate2_HC_58-P1369 | 4043 | QVQLQESGPGLVKPSETLSLTCTVSGGSISGYYWSWIRQPPGKGLEWIGYIYYSGSTNYNPSLKSRVTISVDTSKNQFSLKLSSVTAADTAVYYCARYGWGYDSSGYYFDYWGQGTLVTVSS | 4044 | ARYGWGYDSSGYYFDY | COV107_Plate2_lambda_58-P1409 | 4045 | QSVLTQPASVSGSPGQSITISCTGTSSDVGSYNLVSWYQEHPGKAPKLMIYEGSKRPSGVSNRFSGSKSGNTASLTISGLQAEDEADYYCCSYAGSSTWVFGGGTKLTVL | 4046 | CSYAGSSTWV | LAMBDA |
| COV107_Plate2_HC_71-P1369 | 4047 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARVEDWGYCSSTNCYSGAFDIWGQGTMVTVSS | 4048 | ARVEDWGYCSSTNCYSGAFDI | COV107_Plate2_lambda_71-P1409 | 4049 | QSVLTQPPSVSEAPRQRVTISCSGSSSNIGNNAVNWYQQVPGKAPKLLIYYDDLLPSGVSDRFSGSKSGTSASLAISGLQSEDEADYYCAAWDDSLNGAWVFGGGTKLTVL | 4050 | AAWDDSLNGAWV | LAMBDA |
| COV107_Plate2_HC_72-P1369 | 4051 | QVQLQESGPGLVKPSETLSLTCTVSGASVSSGSYYWSWIRQPPGKGLEWIGYIYYSGSTNYNPSLKSRVTISVDTSKNQFSLKLSSVTAADTAVYYCARERPGGTYSNTWYTPTDTNWFDTWGQGTLVTVSS | 4052 | ARERPGGTYSNTWYTPTDTNWFDT | COV107_Plate2_lambda_72-P1409 | 4053 | SYVLTQPPSVSVAPGKTARITCGGNNIGSKSVHWYQQKPGQAPVLVIYFDSDRPSGIPERFSGSNSGNTATLTISRVEAGDEADYYCQVWDSSRDHVVFGGGTKLTVL | 4054 | QVWDSSRDHVV | LAMBDA |
| COV107_Plate2_HC_72-P1369 | 4055 | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASGYTGYDYFVGGDYYGMDVWGQGTTVTVSS | 4056 | ASGYTGYDYFVGGDYYGMDV | COV107_Plate2_lambda_72-P1409 | 4057 | QSVLTQSPSASASLGASVKLTCTLSSGHSSYAIAWHQQQPEKGPRYLMKLNSDGSHSKGDGIPDRFSGSSSGAERYLTISSLQSEDEADYYCQTWGTGILVFGGGTKLTVL | 4058 | QTWGTGILV | LAMBDA |
| COV107_Plate2_HC_87-P1369 | 4059 | EVQLVQSGAEVKQPGESLKISCKALGYTFTTSWISWVRQMPGKGLEWMGRIDPSDSYTKYSPSFQGHVTISVDKSITTAYLQWSSLKASDSAVYYCATETNSETTDMFTGYSFDPWGQGTLVTVS | 4060 | ATETNSETTDMFTGYSFDP | COV107_Plate2_lambda_87-P1409 | 4061 | QSVLTQPPSASGTPGQRVTIACSGSSSNIGSSPVKWYKQLPGTGPKLLIYSSNQRPSGVPDRFSGSKSGTSASLAISGLQSEDEADYYCAAWDDSLSGYVFGTGTKVTVL | 4062 | AAWDDSLSGYV | LAMBDA |
| COV107_Plate2_HC_88-P1369 | 4063 | QVQLVESGGGVVQPGRSLRLSCAASGFTFSRHAMHWVRQAPGKGLEWVAVISYDGSNKYYADSVKGRFTISRDNSKNTLYLQMNSLRAEDTAVYYCAREDYYDSSGSFDYWGQGTLVTVSS | 4064 | AREDYYDSSGSFDY | COV107_Plate2_lambda_88-P1409 | 4065 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL | 4066 | SSYTSSSTWV | LAMBDA |
| COV107_Plate2_HC_89-P1369 | 4067 | QVQLVESGGGVVQPGRSLRLSCAASGFTFSTYAMHWVRQAPGEGLEWVAVISYDGSNTYYADSVKGRFTISRDNSKNTLYLQMNSLRAEDTAVYYCARDPIWFGELLSPPFVHFDYWGQGTLVTVSS | 4068 | ARDPIWFGELLSPPFVHFDY | COV107_Plate2_lambda_89-P1409 | 4069 | QSVLTQPPSVSAAPGQKVTISCSGSSSNIGNNLVSWYQQLPGTAPKLLIYENNKRPSGIPDRFSGSKSGTSATLGITGLQTGDEADYYCGAWDSSLSAGGVYVFGTGTKVTVL | 4070 | GAWDSSLSAGGVYV | LAMBDA |
| COV107_Plate2_HC_91-P1369 | 4071 | QVQLVESGGGVVQPGRSLRLSCAASGFTFSSSGMHWVRQAPGKGLEWVAIISYDGSNKYYADSVKGRFTISRDNSKNTLSLQMNSLRAEDTAVYYCAKDPLPFRDFFYYYMDVWGKGTTVTVSS | 4072 | AKDPLPFRDFFYYYMDV | COV107_Plate2_lambda_91-P1409 | 4073 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLGVFGTGTKVTVL | 4074 | SSYTSSSTLGV | LAMBDA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_Plate2_HC_92-P1369 | 4075 | QVQLLESGGGLVKPGGSLRLSCAASGFTFSDYYMSWIRQAPGKGLEWVSYISSRSSYTNYADSVKGRFTISRDNAKNSLYLQMNSLRAEDTAVYYCATYRSYLPLVQVDYWGQGTLVTVSS | 4076 | ATYRSYLPLVQVDY | COV107_Plate2_lambda_92-P1409 | 4077 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSKHAVFGGGTQLTVL | 4078 | QSYDSSKHAV | LAMBDA |
| COV107_Plate2_HC_94-P1369 | 4079 | QVQLVQSGAEVKKPGASVKVSCKASGYTFTGYYMHWVRQAPGQGLEWMGWISPVSGGTNYAQKFQGRVTMTRDTSISTAYMELSRLRSDDTAVYYCARAPLFPTGVLAGDYYYYGMDVWGQGTTVTVSS | 4080 | ARAPLFPTGVLAGDYYYYGMDV | COV107_Plate2_lambda_94-P1409 | 4081 | QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSSTLVFGGGTKLTVL | 4082 | CSYAGSSTLV | LAMBDA |
| COV107_6mo_P1_IGG_A1-P1369 | 4083 | QVQLVQSGAEVKKPGASVKVSCKTSGYNFPSYGISWVRQAPGEGLEWMGWINPYNDNTNYAQRVQGRVTMTTDTSTGTAYMEVKSLRSDDTAVYYCARDGYGDYRAYDYWGLGTLVTVSS | 4084 | ARDGYGDYRAYDY | COV107_6mo_P1_Kappa_A1-P1389 | 4085 | DIQMTQSPSSLSASVGDRVTITCRASQSISSYLNWYQQKPGKAPKLLIYAASSLQSGVPSRFGGSGSGTDFTLTISSLQPEDFATYFCQQSFITPRTFGQGTKVEIK | 4086 | QQSFITPRT | KAPPA |
| COV107_6mo_P1_IGG_A2-P1369 | 4087 | QVQLVQSGAEVKTPGASVKVSCKASGYTFTSYGISWVRQAPGQGLEWMGWVSSYNGNTNYAQKFQGRVTMTTDTSTNTVHMELWNLRSDDTAVYYCARVEYYYDSSGTYYFDHWGQGTLVTVSS | 4088 | ARVEYYYDSSGTYYFDH | COV107_6mo_P1_Kappa_A2-P1389 | 4089 | EIVMTQSPATLSVSPGERATLSCRASQSISSNVAWYQQKPGQAPRFLLYGASTRATGIPARFSGSGSGTEFTLTITSLQSEDFAVYYCQQYDDWPPKWTFGQGTKVEIK | 4090 | QQYDDWPPKWT | KAPPA |
| COV107_6mo_P1_IGG_B10-P1369 | 4091 | EVQLVESGGGLIQPGGSLRLSCAASGFTVSSNYMTWARQAPGKGLEWVSVIYSGGTTYYADSVKGRFTISRDKSKSTLYLQMSSLRAEDTAVYYCAVRGFRELYYPHGMEVWGQGTTVTVSS | 4092 | AVRGFRELYYPHGMEV | COV107_6mo_P1_Kappa_B10-P1389 | 4093 | DIQMTQSPSSLSASVGDRVTITCQASQDITNYLNWYQQKPGKAPKLLIYDASTLEAGVPSRFSGSGSGTEFTFTISSLQPEDIATYYCQHYENLPPGFGPGTRVDF | 4094 | QHYENLPPG | KAPPA |
| COV107_6mo_P1_IGG_B12-P1369 | 4095 | QVQLVESGGGVVQPGGSLRLSCAASAFTFSSYAMHWIRQSPGKGLEWVAVISSDGSSKFYADSVKGRFTISRDNSKNTLYLQMNSLSAEDTAVYYCARDLENVLIEVALQDWGQGTLVTVSS | 4096 | ARDLENVLIEVALQD | COV107_6mo_P1_Kappa_B12-P1389 | 4097 | DIQMTQSPSSLSASVGDRVTITCRASQSINSYLNWYQQKPGKAPKLLIYAASSLHSGVPSRFSGSGSGTDFTLTISSLQPEDFATYYCQQSYTTLALTFGGGTKVEIK | 4098 | QQSYTTLALT | KAPPA |
| COV107_6mo_P1_IGG_B2-P1369 | 4099 | EVQLVESGGGLIQPGGSLRLSCAASILTVSRNYMSWVRQAPGKGLEWVSSIYSGGTTYYADSVKGRFTISRDDSKNTLYLQMNSLRAEDTAVYYCARPVVGGRAGMDVWGQGTTVTVSS | 4100 | ARPVVGGRAGMDV | COV107_6mo_P1_Kappa_B2-P1389 | 4101 | DIQMTQSPSSLSASVGDRVTITCQASQDINKYLNWYQQKPGKAPKLLIYDASNLETGVPSRFSGSGSGTDFTFTISSLQPEDIGTFYCLHNDNPPLTFGGGTKVEIK | 4102 | LHNDNPPLT | KAPPA |
| COV107_6mo_P1_IGG_B3-P1369 | 4103 | QVQLQESGPGLVKPSQTLSLTCTVSGGSISSGDYYWSWIRQPPGKGLEWIGYIYYSGSTNYNPSLRSRVTISVDTSKNQFSLRLRSVTAADTAVYYCAAIGSASYGVEYFQHWGQGTLVTVSS | 4104 | ARDAIGSASYGVEYFQH | COV107_6mo_P1_Kappa_B3-P1389 | 4105 | EIVLTQSPGTLSLSPGERATLSCRASQSVSSRYLAWYQQKPGQAPRLLIYGASSRATGIPDRFSGSGSGTEFTLTISRLEPEDFAVYYCQQYGSSPPYTFGQGTKLEIK | 4106 | QQYGSSPPYT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_6mo_P1_IGG_B6-P1369 | 4107 | QVQLVESGGGVVQPGRSLRLSCAASGFSFSTYGMHWVRQAPGKGLEWVAVISYDGSNKYSADSVKGRFTISRDNSKNTLYLQMNSLRAEDTAVYYCAKDIGGSYYLMYYFDYWGQGTLVTVSS | 4108 | AKDIGGSYYLMYYFDY | COV107_6mo_P1_Kappa_B6-P1389 | 4109 | DIQMTQSPSSLSAFVGDRVTITCQASQDIGNYLNWYQQKPGKPPKLLIYDASNLEAGVPSRFSGSGSGTDFTFTISSLQPEDIATYYCQQYDILPPITFGQGTRLEIK | 4110 | QQYDILPPIT | KAPPA |
| COV107_6mo_P1_IGG_B7-P1369 | 4111 | QVQLVESGGGLVKPGGSLRLSCAASGFTFSEYYMSWIRQAPGKGAEVGLCGSSSRTWRIXADFVXSLWXXXQDNAKNSLYLQMNSLRAEDTAVYYCAREQQLPINWFDTWGQGTLVTVSS | 4112 | AREQQLPINWFDT | COV107_6mo_P1_Kappa_B7-P1389 | 4113 | EIVLTQSPATLSLSPGERATLSCRASQSVSSYLAWYQQKPGQAPRLLIYDASNRATGIPARFSGSGSGTDFTLTITSLEPEDFAVYYCQQRSNWPSTFGGGTKVEIK | 4114 | QQRSNWPST | KAPPA |
| COV107_6mo_P1_IGG_C10-P1369 | 4115 | EVQLVESGGGLVQPGGSLRLSCAASGFTFSTYDMHWVRQPTGKGLEWVSAIGSGGDTYYAGSVKGRFTISRESAKNSLYLQMNSLTAGDTAVYYCARGDHKSGWSEHRSFYFYYMDVWGKGTTVTVS | 4116 | ARGDHKSGWSEHRSFYFYYMDV | COV107_6mo_P1_Kappa_C10-P1389 | 4117 | DIQMTQSPSSLSASVGDRVTVTCRASQSISTYLNWYQLKPGKAPNLLIYGTSSLQVGVPSRFIGSGSGTDFTLTISSVQPEDFATYYCQQSYITTAYTFGQGTKLEIK | 4118 | QQSYITTAYT | KAPPA |
| COV107_6mo_P1_IGG_C1-P1369 | 4119 | QVQLVESGGGVVQPGRSLRLSCAASGITFSHYGMHWVRQAPGKGLEWVALISSDGSKKYYADSVKGRFTISRDNSKNTVYLQMNSLRAEDTALYYCAKDLGYYYGPPYGPDYWGQGTLVTVS | 4120 | AKDLGYYYGPPYGPDY | COV107_6mo_P1_Kappa_C1-P1389 | 4121 | DIQMTQSPSSLSASVGDRVTITCQASQDVSNSLNWYQQKPGKAPKLLIYGASNLETGVPSRFSGSGSGTDFSFTISSLQPEDIATYYCLQYDNFSMYTFGQGTKLEIK | 4122 | LQYDNFSMYT | KAPPA |
| COV107_6mo_P1_IGG_C2-P1369 | 4123 | QVQLVESGGGVVQPGRSLRLSCAASGFTFSNYGMHWVRQAPGKGLEWVAVISYDGSNKYYADSVKGRFTISRDNSKNTLYLQMNSLRAEDTAVFYCAKQTAPYCSGGNCYSGYFDYWGQGTLVTVSS | 4124 | AKQTAPYCSGGNCYSGYFDY | COV107_6mo_P1_Kappa_C2-P1389 | 4125 | DIQMTQSPSSLSASVGDRVTITCRASQSISSYLNWYQQKPGKAPRLLIYAASYLHSGVPSRFSGSGSATDFTLTISSLQPEDFATYYCQQSYSAPPGPYTFGQGTKLEIK | 4126 | QQSYSAPPGPYT | KAPPA |
| COV107_6mo_P1_IGG_C3-P1369 | 4127 | EVQLVESGGGLIQPGGSPRLSCAASGITVSSNYMSWVRQAPGKGLEWISVIYSGGSTFYADSVKGRFTISRDDSKNTLYLQMHSLRADDTAMYYCARAVWDAFDIWGQGTMVTVSS | 4128 | ARAVWDAFDI | COV107_6mo_P1_Kappa_C3-P1389 | 4129 | DIQLTQSPSFLSASVGDRVTITCRASQGISSYLAWYQQKPGKAPKLLIYTASTLQSGVPSRFSGSGSGTEFTLTISSLQPEDFATYYCQHLNSYPSPNTFGQGTKLEIK | 4130 | QHLNSYPSPNT | KAPPA |
| COV107_6mo_P1_IGG_C4-P1369 | 4131 | QVQLVESGGGVVQPGRSLRLSCAASGFTFSTYGMHWVRQAPGKGLEWVTVISYDGSNKYYSDSVKGRFTISRDNSQNTLYLQMNSLSAEDTAVYYCAKSISPYTSGWYYFDYWGQGTLVTVSS | 4132 | AKSISPYTSGWYYFDY | COV107_6mo_P1_Kappa_C4-P1389 | 4133 | DIQMTQSPSSLSASVGDRVTITCQASQDISNYLNWYQQKPGKVPKLLIYDASSLETGVPSRFSGSGSGTNFTFTISSLQPEDIATYYCLQYNNLPLTFGGGTKVEIK | 4134 | LQYNNLPLT | KAPPA |
| COV107_6mo_P1_IGG_C7-P1369 | 4135 | QVQLVESGGGVVQPGRSLRLSCAASGFTFSSYGMHWVRQAPGKGLEWVAVILSDGSGKLYADSVKGRFTISRDNSKSTLYLQMSSLRAEDSAVYYCARDGPPTSLVTCPDFWGQGTLVTVSS | 4136 | ARDGPPTSLVTCPDF | COV107_6mo_P1_Kappa_C7-P1389 | 4137 | DIQMTQSPSSLSASVGDRVTITCRASQSIGSYLNWYQQKPGKAPKLLIYAASSLQSGVPSRFSGSGSGTDFTLTISSLQREDFATYYCQQSYSTPPWTFGQGTTVDI | 4138 | QQSYSTPPWT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_6mo_P1_IGG_D12-P1369 | 4139 | EVQLVESGGGLVQPGGSLRVSCAASGFTFKSYDMHWVRQVTGKGLEWVSVIGTAGDTYYLDSVKGRFTISRENAKNSLYLQMNSLTAGDTAIYYCARGDMATRRPFYYYYMDVWGKGTAVTVSS | 4140 | ARGDMATRRPFYYYYMDV | COV107_6mo_P1_Kappa_D12-P1389 | 4141 | DIQMTQSPSSLSASVGDRVTITCRASQTISRYLNWYQQKPGEAPRLLIFAASTLQSGVPTRFSGSGSGTDFTLTITSLQPEDFATYWCQQSYSNPNLTFGGGTKVEIK | 4143 | QQSYSNPNLT | KAPPA |
| COV107_6mo_P1_IGG_D2-P1369 | 4143 | EVQLVESGGGLIQPGGSLRLSCAASGLIVSSNYMNWVRQAPGKGLEWVSLIYSGGSTYYADSVKGRFTISRDNSKNTLYLQMNSLRPEDTAVYYCARDFSVVGAFDIWGQGTVVTVSS | 4144 | ARDFSVVGAFDI | COV107_6mo_P1_Kappa_D2-P1389 | 4145 | EIVLTQSPGTLSLSPGERATLSCRASQSLPSTYLAWYQQKPGQAPRLLIYGASSRATGIPDRFSGSGSGTDFTLTISRLEPEDFAVYYCQQYGTSPRVTFGPGTKVDIK | 4146 | QQYGTSPRVT | KAPPA |
| COV107_6mo_P1_IGG_D6-P1369 | 4147 | QVQLVESGGGVVQPGKSLRLSCAASGFTFSRYGMHWVRRAPGKGLEWVAGISYDGSNKYYADSVKGRFTISRDNSKNTLYLQMNSLRAEDTALFFCAKVSGPYCSGHSCYSATFDYWGQGTLVTVSS | 4148 | AKVSGPYCSGHSCYSATFDY | COV107_6mo_P1_Kappa_D6-P1389 | 4149 | DIQMTQSPSSLSASVGDRVTIICQASQDISNYLNWYQQKPGKAPKLLIYDASNLETGVPSRFSGSGSGTDFAFTISGLQPEDIATYYCQQYDHLPPTFGQGTKVEIK | 4150 | QQYDHLPPT | KAPPA |
| COV107_6mo_P1_IGG_E10-P1369 | 4151 | QVQLVQSGAEVKKPGSSVKVSCKASGDTFSIYAFSWVRQAPGQGLQWMGAIIPLLGTTNYAQKFLGRVTITADESTSTTFMELSSLTSEDTAVYHCATFHVAYGDYIPFDSWGQGTLVIVSS | 4152 | ATFHVAYGDYIPFDS | COV107_6mo_P1_Kappa_E10-P1389 | 4153 | EIVLTQSPGTLSLSPGERATLSCRASQSVSSSYLAWYQQKPGQAPRLLIYGASSRATGIPDRFSGSGSGTDFTLTISRLEPEDFAVYYCQQYGRSPTWTFGQGTKVEIE | 4154 | QQYGRSPTWT | KAPPA |
| COV107_6mo_P1_IGG_E11-P1369 | 4155 | QVQLVQSGAEVKKPGASVKVSCKASGYTFTSYALHWVRQAPGQRLEWMGWINVGNGTTKYSQKFQGRVTITRDTSASTAYMELSSLRSDDTAVYYCARVPRGYYDRSGHYHGQDYFDYWGQGTLVTVSS | 4156 | ARVPRGYYDRSGHYHGQDYFDY | COV107_6mo_P1_Kappa_E11-P1389 | 4157 | EIVLTQSPGTLSLSPGERATLSCRASQSLSSNYLAWYQQKPGQAPRLLIYGASSRATAIPDRLSGSGSGTDFTLTISRLEPEDFAVYYCQQYGSSPITFGQGTRLEIK | 4158 | QQYGSSPIT | KAPPA |
| COV107_6mo_P1_IGG_E12-P1369 | 4159 | EVQLVESGGGLIQPGGSLRLSCTASGLIVSSNYMSWIRQAPGKGLEWVSLIYSGGSTFYADSVKGRFTISRDNSKNTLFLHMNSLRAEDTAVYYCARHPYGTDVWGQGTTVTVSS | 4160 | ARHPYGTDV | COV107_6mo_P1_Kappa_E12-P1389 | 4162 | DIQMTQSPSSLSASVGDRVTITCQASQDIVKYXNWYQQKSGKAPKLLIHDASNLETGVTSRFSGSGSGTHFTFTISSLQPEDLATYYCQQYDNLPITFGQGTRLEIK | 4162 | QQYDNLPIT | KAPPA |
| COV107_6mo_P1_IGG_E1-P1369 | 4163 | QVQLVQSGAEVKKPGASVKVSCKASGDTFTSYDINWVRQATGQGLEWMGWMNRNSGNTDYAQKFQGRVTMTRNTSISTAYMELSSLRSEDTAVYYCVSRRWDPLRFYYYMDVWGKGTTVTVSS | 4164 | VSRRWDPLRFYYYMDV | COV107_6mo_P1_Kappa_E1-P1389 | 4165 | DIVMTQSPLSLPVTPGEPASISCRSSQSLLHSNGYNYLDWFLQKPGQSPQLLIYLGSNRASGVPDRFSGSGSGTDFTLKISRVEAEDVGVYYCMQALQTPPTFGGGTKVEI | 4166 | MQALQTPPT | KAPPA |
| COV107_6mo_P1_IGG_E6-P1369 | 4167 | QVQLVESGGGVVQPGGSLRLSCAASGFTFRNYGMHWVRQAPGKGLECVAVIWYDGSNKYYGDSVKGRFTISRDNSKNTLYLQMNSLRAEDTALYYCARDNEITAIDIDYWGQGTLVTVSS | 4168 | ARDNEITAIDIDY | COV107_6mo_P1_Kappa_E6-P1389 | 4169 | DVVMTQSPLSLPVTLGQPASISCRSSQSLVHSDGNTYLNWFQQRPGQSPRRLIYKVSNRDSGVPDRFSGSGSGTYFTLKISRVEAEDVGVYYCMQGTHWPGTFGPGTKVDIK | 4170 | MQGTHWPGT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_6mo_P1_IGG_E7-P1369 | 4171 | QVQLVQSGAEVKKPGASVKVSCKASGYTFTSYDINWVRQAPGQGLEWMGWMNPNSGNTDYAQKFQGRFTMTRNTSISTAYMELSSLRSEDTAVYYCASRRWDPLTFYYYMVVWGKGTTVTVSS | 4172 | ASRRWDPLTFYYYMVV | COV107_6mo_P1_Kappa_E7-P1389 | 4173 | DIVMTQSPLSLPVTPGEPASISCRSSQSLLYSNGYNYLDWYLQKPGQSPQLLIYLGSNRASGVPDRFSGSGSGTDFTLKISRVEAEDVGVYFCMQALQTPPTFGGGTKVEIK | 4174 | MQALQTPPT | KAPPA |
| COV107_6mo_P1_IGG_E9-P1369 | 4175 | QVQLVESGGGVVQPGRSLRLSCAASGFSFSSYAMHWVRQAPGKGLEWVAVISYDETNKYYGDSVKGRFTISRDNSKNTLYLQMNSLRAEDTAVYNCARVLGRGSVAGNIKSTLFGLDAFDIWGQGTMVTVSS | 4176 | ARVLGRGSVAGNIKSTLFGLDAFDI | COV107_6mo_P1_Kappa_E9-P1389 | 4177 | EIVMTQSPATLSVSPGESATLSCRASQSVSSNLAWYQQKPGQAPRLLIYGASTRATGIPARFSGSGSGTEFTLTISSLQSEDFAVYYCQQYNNWPPAFTFGPGTKVDIK | 4178 | QQYNNWPPAFT | KAPPA |
| COV107_6mo_P1_IGG_F12-P1369 | 4179 | QMQLVQSGPEVKKPGTSVKVSCKASGFIFSSSAVQWVRQARGQRLEWIGWIVVGSGNTNYAQKFQERVTISRDMSTSTAYIHLSSLRSEDTAVYYCAAPSCTSTICYDAFNIWGQGTMVTVSS | 4180 | AAPSCTSTICYDAFNI | COV107_6mo_P1_Kappa_F12-P1389 | 4181 | EIVLTQSPGTLSLSQGERATLSCRASQSVRSSYLAWYQQKPGQAPRLLIYGASIRATGIPDRFSGSGSGTDFTLTISRLEPEDFAVYYCQHYGGSLFTFGPGTKVDIK | 4182 | QHYGGSLFT | KAPPA |
| COV107_6mo_P1_IGG_F2-P1369 | 4183 | QVQLVESGGGVVQPGRSLRLSCAASGFTFRSHAMHWVRQAPGKGLEWVAIISSDGFNKYYADSVKGRFTISRDNSKNTLYVHMNSLRVEDTAIYYCASGLLWFETREISGAPDYGMAVWGQGATVTVSS | 4184 | ASGLLWFETREISGAPDYGMAV | COV107_6mo_P1_Kappa_F2-P1389 | 4185 | DIQMTQSPSSLSASVGDRVTITCRASQNISNFLNWYQQKPGKAPKLLIYAASSLQSGVPSRYSGSGSGTDFTLTISSLQAEDFATYYCQQSYSTPLTFGGGTKVEIK | 4186 | QQSYSTPLT | KAPPA |
| COV107_6mo_P1_IGG_F5-P1369 | 4187 | EVQLVESGGGLIQPGGSLRLSCAASGVTVSSNYMNWVRQAPGKGLEWVSVIYSGGSTFYADSVKGRFTISRDNSKNTLYLQMNSLRAEDTAVYYCARESYHSAFDIWGQGTMVTVSS | 4188 | ARESYHSAFDI | COV107_6mo_P1_Kappa_F5-P1389 | 4189 | DIQLTQSPSFLSASVGDRVTITCRASQGISSYLAWYQQKPGKAPKLLIYGASTLQSGVPSRFSGSGSGTEFTLTINSLQSEDFATYYCQQLNSYPPRDTFGQGTKLEIK | 4190 | QQLNSYPPRDT | KAPPA |
| COV107_6mo_P1_IGG_F9-P1369 | 4191 | EVQLVQSGAEVKKPGESLRISCKGSGYSFTSYWISWVRQMPGKGLEWMGRIDPSDSYTNYSPPFQGHVTFSADKSISTAYLHWSSLKASDTAIYYCARPPRYYYDRSGYYVWEDYFDYWGQGTLVTVSS | 4192 | ARPPRYYYDRSGYYVWEDYFDY | COV107_6mo_P1_Kappa_F9-P1389 | 4193 | EIVLTQSPGTLSLSPGESATLSCRASQSVSSSYLAWYQQKPGQAPRLLIYGASSRATGIPDRFSGSGSGTDFTLTISRLEPEDFAVYYCQQYGSSPYTFGQGTKLEVK | 4194 | QQYGSSPYT | KAPPA |
| COV107_6mo_P1_IGG_H11-P1369 | 4195 | EVQLVESGGGLVQPGGSLRLSCAASGFTFSTYDMHWVRQATGKGLEWVSAIGTAGDKYYPGSVKGRFTISRENAKNSLYLQMNSLRAGDTAVYYCVRAGYSSGWPLYWYFDLWGRGTLVSVSS | 4196 | VRAGYSSGWPLYWYFDL | COV107_6mo_P1_Kappa_H11-P1389 | 4197 | DIQMTQSPSSLSASVGDRVTITCRASQSISSYLNWYQQKPGKAPKFLIYAASSLQSGVPSRFSGSGSGTDFTLTISNLQPEDFATYYCQQSYRTPPEFTFGPGTKVDIK | 4198 | QQSYRTPPEFT | KAPPA |
| COV107_6mo_P1_IGG_H3-P1369 | 4199 | QVQLVQSGAEVKKPGASVKVSCTASGYTFSSYYIHWVRQAPGQGLEWMGIINPGAGSTTYAQKFQGRVAMTTDTSTRTVYMELSSLRSDDTAVYYCGRDEAFLPSAIFVGDYWGQGTLVTVSS | 4200 | GRDEAFLPSAIFVGDY | COV107_6mo_P1_Kappa_H3-P1389 | 4201 | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPHTWTFGQGTKVEIK | 4202 | LQHNSYPHTWT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_6mo_P1_IGG_H5-P1369 | 4203 | QVQLVESGGGLVKPGGSLRLSCAGSGFTFTDYYMAWIRQAPGKGLEWVSYISTSDRFINYADSVKGRFTISRDDAKNSLYLQMNSLRAEDTAVYYCARDGGGYDRFDHWGQGTLVTVSS | 4204 | ARDGGGYDRFDH | COV107_6mo_P1_Kappa_H5-P1389 | 4205 | DIQMTQSPSSLSASVGDRVTITCQASQDISNLLNWYQQKAGKAPKLLIYDASNLETGVPSRFSGSGSGTDFTFTISSLQPEDIATYYCLQYDNLPLTFGQGTRLEIK | 4206 | LQYDNLPLT | KAPPA |
| COV107_6mo_P1_IGG_H8-P1369 | 4207 | EVQLVESGGGLVQPGGSLRLSCAASGFTFNNYDMHWVRQGTGKRLQWVSVIGTSGDTYYSDSVKGRFTISRENAKNSLYLQMNSLRAGDTAVYYCVRGTTVVRGLIEKYYHYYVMDVWGQGTTVTVSS | 4208 | VRGTTVVRGLIEKYYHYYVMDV | COV107_6mo_P1_Kappa_H8-P1389 | 4209 | DIQMTQSPSSLSASVGDRVTITCRASQSISSYLNWYQQKIGKAPKLLIYAASSLSGVPSRFSGSGSGTDFTLTISSLQPEDFATYYCQQSYSNPGWTFGQGTKVEIK | 4210 | QQSYSNPGWT | KAPPA |
| COV107_6mo_P2_IGG_A12-P1369 | 4211 | EVQLVESGGGLFQPGGSLKLSCVASGLTVSANYMNWVRQAPGKGLEWVSVIYSGGSAFYADSVKGRFTISRDISKNTLFLQMNTLRAEDTAVYYCARDLVVYGMDVWGQGTTVIVSS | 4212 | ARDLVVYGMDV | COV107_6mo_P2_Kappa_A12-P1389 | 4213 | DIQLTQSPSFLSASVGDRVTITCRARQGISNFLAWYQQKPGRAPKLLIYGASTLQSGVPSRFSGSGSGTEFTLTISSLQPEDFATYYCQQLNSDPITFGQGTRLEIK | 4214 | QQLNSDPIT | KAPPA |
| COV107_6mo_P2_IGG_A1-P1369 | 4215 | EVQLVESGGGLIQPGVSLRLSCAVSGFTVSRNYMSWVRQAPGKGLEWVSVIYPGGSTFYADSVKGRFTISRDNSKNTLHLQMNSLRAEDTAVYYCARDFYRPTTFRGEAKGDYWGQGTLVTVSS | 4216 | ARDFYRPTTFRGEAKGDY | COV107_6mo_P2_Kappa_A1-P1389 | 4217 | DIQMTQSPSSLSASVGDRVTITCQASQDINNYLNWYQQKPGEAPKLLIYDASNLETGVPSRFSGSGSGTDFTFTISSLQPEDIATYYCHQYDNLPRTFGQGTKVEIK | 4218 | HQYDNLPRT | KAPPA |
| COV107_6mo_P2_IGG_A2-P1369 | 4219 | QVQLVESGGALVKPGGSLRLSCAASGFTFSDHYMSWIRQAPGRGLEWVSYISTSSSDTSYADSVKGRFTISRDNAKNSLFLQMNSLRAEDTAVYYCARDSEWLQFASFDYWGQGTLVTVS | 4220 | ARDSEWLQFASFDY | COV107_6mo_P2_Kappa_A2-P1389 | 4221 | EIVLTQSPGTLSLSPGERATLSCRASQSVSSSYLAWYQQKPGQAPRLVIYGAISRAAGIPDRFSGSGSETDFTLTISRLEPEDFAVYYCQQYGSSHTFGQGTRLEIK | 4222 | QQYGSSHT | KAPPA |
| COV107_6mo_P2_IGG_A7-P1369 | 4223 | QVQLVESGGGVVQPGRSLRLSCAASGITFSHYGMHWVRQAPGKGLEWVALISSDGSKKYYADSVKGRFTISRDNSKSTLYLQMNSLRAEDTAIYYCAKDLGYYYGPPYGPDYWGQGTLVTVSS | 4224 | AKDLGYYYGPPYGPDY | COV107_6mo_P2_Kappa_A7-P1389 | 4225 | DIQMTQSPSSLSASVGDRVTITCQASQDVSNSLNWYQQKPGKAPKLLIYDASNLETGVPSRFSGSGSGTDFSFTISSLQPEDIATYYCLQYDNFSMYTFGQGTKLEIK | 4226 | LQYDNFSMYT | KAPPA |
| COV107_6mo_P2_IGG_B10-P1369 | 4227 | QVQLVESGGNVVQPGRSLRLSCAASGFTFSNYGMHWIRQAPGKGLEWVAVISYDGSDKYYADSVKGRVTISRDNSKNTLYLQMNSLRAEDTAVYYCAKGGPYGDHVRSDYWGLGTLVTVSS | 4228 | AKGGPYGDHVRSDY | COV107_6mo_P2_Kappa_B10-P1389 | 4229 | DIQMTQSPSSLSASVGDRVTITCQASQDISNYLNWYQQKPGKVPKLLIYDASNLETGVPSRFSGSGSGTDFTFTISSLQPEDIATYYCQQFHNLPLTFGQGTKLEIK | 4230 | QQFHNLPLT | KAPPA |
| COV107_6mo_P2_IGG_B11-P1369 | 4231 | QLQLQESGPGLVKPSETLSLTCAVSGGSISNSPFYWGWIRQPPGKGLECIGSIYYSGSTYYNPSLKSRVTISVDTSKKQFSLKLSSVTAADTAVYYCARHFADGSGRVVDSWGQGILVTVSS | 4232 | ARHFADGSGRVVDS | COV107_6mo_P2_Kappa_B11-P1389 | 4233 | EIVLTQSPATLSLSPGERATLSCRASQSVSSYLAWYQQKPGQAPSLLIYDVSNRATGIPARFSGSGSGTDFTLTISSLEPEDFAVYYCQQRINWPLYTFGQGTKLEIK | 4234 | QQRINWPLYT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_6mo_P2_IGG_C10-P1369 | 4235 | QVQLVQSGAEVKKPGSSVKVSCKASGGDFTTYAITWVRQAPGQGLELMGGLIPLFGTANSAQKFQGRVTITADESTSTAYLELSSLSSEDTAVYYCARGRWRAAALSTLRTAFDYWGQGTLLTVSS | 4236 | ARGRWRAAALSTLRTAFDY | COV107_6mo_P2_Kappa_C10-P1389 | 4237 | EIVMTQSPATLSVSPGERVTLSCRASQSVSSNLAWYQQKPGQAPRLLIYGASTRATGIPARFSGSGSGTEFTLTISSLQSEDFAIYYCQQYNKWPMYTFGQGTKLEIK | 4238 | QQYNKWPMYT | KAPPA |
| COV107_6mo_P2_IGG_C2-P1369 | 4239 | EVQLVESGGGLVQPGGSLRLSCSASGFTFTTYAMHWVRQAPGKGLEYVSTISSNGDSTYYADSVKGRFTISRDNSKNTLHLQMSSLRTEDTAVYYCVKDELGGYFGNYFDYWGQGTLVTVSS | 4240 | VKDELGGYFGNYFDY | COV107_6mo_P2_Kappa_C2-P1389 | 4241 | DIQMTQSPSSLSASVGDRVTITCRASQSISSYLNWYQQKPGKAPRLLIYAASYLHSGVPSRFSGSGSATDFTLTISSLQPEDFATYYCQQSYSAPPGPYTFGQGTKLEIK | 4242 | QQSYSAPPGPYT | KAPPA |
| COV107_6mo_P2_IGG_C3-P1369 | 4223 | EVQLVESGGGLIKPGRSLRLSCTASGFTFGDYAMTWFRQAPGKGLEWVGFIRSKAYGGTTGYAASVKYRFTISRDDSKSIAYLQMDSLKTEDTAVYYCTRWDGWSQHDYWGQGTLVTVSS | 4224 | TRWDGWSQHDY | COV107_6mo_P2_Kappa_C3-P1389 | 4225 | DIVMTQSPLSLSVTPGEPASISCRSSQSLLHSNGNNYFDWYLQKPGQSPQLLIYLASNRASGVPDRFSGSGSGTDFTLKISRVEAEDVGVYYCMQVLQIPYTFGQGTKLEI | 4226 | MQVLQIPYT | KAPPA |
| COV107_6mo_P2_IGG_C4-P1369 | 4227 | QVQLVQSGAEVKKPGSSVKVSCKASGGSFSTYAISWVRQAPGQGLEWMGGIIPAFGTANYAQKFQGRVTIAADESTSTAFMELSSLRSEDTAVYYCARGGCSSNSCYAAQYGMDVWGQGTTVTVSS | 4228 | ARGGCSSNSCYAAQYGMDV | COV107_6mo_P2_Kappa_C4-P1389 | 4229 | DIQMTQSPSSLSASIGNRVTITCQASQDINNYLNWYQQKPGKAPKLLIYDASNLETGVPSRFSGSGSGTDFTFTISSLQPEDIATYYCQQYDNPALTFGGGTKVEIK | 4230 | QQYDNPALT | KAPPA |
| COV107_6mo_P2_IGG_D10-P1369 | 4251 | QVQLVQSGAEVKKPGASVKVSCKVSGYNLTELSMYWVRQAPGKGLEWMGGFDPEDGGPIHAQKFQGRVTMTEDPSTDTAYMELRSLRSEDTALYYCATGGLFMIRGLEIWGRGTLVSVSS | 4252 | ATGGLFMIRGLEI | COV107_6mo_P2_Kappa_D10-P1389 | 4253 | EIVLTQSPGTLSLSPGERATLSCRASQSISYTSLAWYQQKPGQAPRLLIFGASRGATGTPDRFSGSWSGTDFTLTISRLEPEDFAVYYCQQYGNSPRLSFGGGTKVEIK | 4254 | QQYGNSPRLS | KAPPA |
| COV107_6mo_P2_IGG_D2-P1369 | 4255 | EVQLVESGGGLIQPGGSLRLSCAASGLIVSSNYMNWVRQAPGKGLEWVSLLYSGGSTYYADSVKGRFTISRDNSKNTLYLQMNSLRPEDTAVYYCARDLSVVGAFDIWGQGTVVTVSS | 4256 | ARDLSVVGAFDI | COV107_6mo_P2_Kappa_D2-P1389 | 4257 | EIVLTQSPGTLSLSPGERATLSCRASQSLPSTYLAWYQQKRGQAPRLLIYGASSRATGIPDRFSGSGSGTDFTLTISRLEPEDFAVYYCQQYGTSPRVTFGPGTKVDIK | 4258 | QQYGTSPRVT | KAPPA |
| COV107_6mo_P2_IGG_D4-P1369 | 4259 | EVQLVESGGGLIQPGGSLRLSCAASGLTVSNNYVSWVRQGPGKGLEWVSVIYSDAKTYYADSVKGRFSISRDNSKNTVYLQMNSLRAEDTAVYHCARLPPHRGDRDYWGQGTLVTVSS | 4260 | ARLPPHRGDRDY | COV107_6mo_P2_Kappa_D4-P1389 | 4261 | DIQMTQSPSSLSASVGDRVTITCRASQGISDYLAWYQQKPGKVPNLLIYAASTLQSGVPSRFSGSGSGTDFTLTISGLQPEDVATYYCQKYDSTPLTFGGGTKVEIK | 4262 | QKYDSTPLT | KAPPA |
| COV107_6mo_P2_IGG_D5-P1369 | 4264 | QVQLQESGPGLVKPSETLSLTCSVSGGSISSYYWSWIRQPPGKGLEWIGNIFYSGSTNYNPSLKSRVTISIDTSKDQFSLKLSSVTAADTAVYYCATYYYDSTGYSYGMDVWGQGTTVTVSS | 4265 | ATYYYDSTGYSYGMDV | COV107_6mo_P2_Kappa_D5-P1389 | 4266 | DIQMTQSPSSLSASIGDRVTITCRASQSIGSYLHWYQQRPGKAPKLLIYAVSNLQSGVPSRFSGRGSGTDFTLTVSSLQPEDFATYYCQQTYSSPQTFGQGTKVDIK | 4267 | QQTYSSPQT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_6mo_P2_IGG_D6-P1369 | 4267 | QVQLVESGGGVVQPGRSLRLSCAASGFMFSSYGMHWVRQAPGKGLEWVAVIYYDGSNKYYADSVKGRFTISRDNSKNTLYLQMNSLRAEDTAVYYCAKDGLPLRGSGSPYGMDVWGQGTMVTVSS | 4268 | AKDGLPLRGSGSPYGMDV | COV107_6mo_P2_Kappa_D6-P1389 | 4269 | DIQMTQSPSSLSASVGDRVTITCRASQSIITYLNWYQQKPGKAPKLLIYDASSLQSGSRFSGSGSGTDFTLTISNLQPEDFATYYCQQSYRTLLTFGGGTKVGIK | 4270 | QQSYRTLLT | KAPPA |
| COV107_6mo_P2_IGG_D8-P1369 | 4271 | QVQLQQWGAGLLKPSETLSLTCAVYGGSFSGYFWSWIRQPPGKGLEWIGEIDHNGVTNYNASLRSRVTISLDTSKNQFSLNLISLTAADTALYFCAIINNSGWRYDAFDIWGQGTMVTVSS | 4272 | AIINNSGWRYDAFDI | COV107_6mo_P2_Kappa_D8-P1389 | 4273 | DIQMTQSPSSLSASVGDRVTITCRASQSISSFLNWYQQKPGKAPKLLIYAASSLQSGVPSRFSGSGSGTDFTLTIRSLQPEDFATYYCQQSYFTPRAFGHGTKVEMK | 4274 | QQSYFTPRA | KAPPA |
| COV107_6mo_P2_IGG_E12-P1369 | 4275 | QVQLVQSGAEVKKPGSSVKVSCKASGGTFSIYAINWLRQAPGQGLEWMGGIIPISGTANYEQKLQGRLTITADESTSTAYMELSSLRSEDTALYYCARTGRSYYSDNSGYYPYFDYWGQGTLVTVSS | 4276 | ARTGRSYYSDNSGYYPYFDY | COV107_6mo_P2_Kappa_E12-P1389 | 4277 | DIQMTQSPSSLSASVGDRVTITCRASQSISNYLNWYQQKPGKAPKLLIYAASSLQSGVPSRFSGSGSGTDFTLTISSLQPEDFATYYCQQSYRTITFGGGTKVEIK | 4278 | QQSYRTIT | KAPPA |
| COV107_6mo_P2_IGG_E1-P1369 | 4279 | QVQLVESGGGVVQPGKSLRLSCAASGFTFSVYGLHWVRQAPDKGLEWVATISYDGNNKYYADSVKGRFTIFRDYSKNTLYLQMNSLRPEDTALYYCAKDHSSLSGAFGDLIGSGPVDPWGQGTLVTVSS | 4280 | AKDHSSLSGAFGDLIGSGPVDP | COV107_6mo_P2_Kappa_E1-P1389 | 42181 | EIVMTQSPATLSVSPGERATLSCRAGQNVSSNLAWYQQKPGQAPRLLIYGASTRAAGIPARFSGSGSGTEFTLTISILQSEDFAVYYCQQYNNRPRGYTFGQGTKLEIK | 4282 | QQYNNRPRGYT | KAPPA |
| COV107_6mo_P2_IGG_E2-P1369 | 4283 | EVQLVESGGGWIQPGGSLRLSCAASGITVSSNYMSWVRQAPGKGLEWVSVIYAGGSTFYADSVKGRFTISRDNSKNTLYLQMNSVRAEDTAVYYCAREIYDDVLDTWGQGTMVTVSS | 4284 | AREIYDDVLDT | COV107_6mo_P2_Kappa_E2-P1389 | 4285 | DIQLTQSPSSLSASVGDRVTITCRASQGISSYLAWYQQKPGKAPKLLIYAASTLQSGVPSRFSGSGSGTEFTLTISSLQPEDLATYYCQQLNSYLHTFGQGTKLEI | 4286 | QQLNSYLHT | KAPPA |
| COV107_6mo_P2_IGG_F10-P1369 | 4287 | EVQLVESGGGLVQPGGSLRLSCAASGFTFSNYDMHWVRQVTGKGLEWVSVIGTEGDTHYSDSVKGRFTISRENAKKSLYLQMNSLRAGDTAVYYCARDLGSGWVWVMDVWGQGTTVTVSS | 4288 | ARDLGSGWVWVMDV | COV107_6mo_P2_Kappa_F10-P1389 | 4289 | DIQMTQSPSSLSASVGDRVTITCRASQSISGYLNWYQQKPGKAPKLLIYAASNLQSGVPSRFSGSGSGTDFTLTISSLQPEDFATYYCQQSYSNPPLTFGGGTKVEIK | 4290 | QQSYSNPPLT | KAPPA |
| COV107_6mo_P2_IGG_F11-P1369 | 4291 | QVQLVQSGAEVKKPGSSVKVSCKASGGTFSSYAIIWVRQAPGQGLEWMGGIIPIFGTANYAQNFQGRVTITADESTSTAYMELNSLRSEDTALYYCAAYYYDSSGILGGDDYWGQGTLVTVSS | 4292 | AAAYYYDSSGILGGDDY | COV107_6mo_P2_Kappa_F11-P1389 | 4293 | EIVLTQSPATLSLSPGERATLSCRASQSVSNYLAWYQQKPSQAPRLLIFDASHRATGIPARFSGSGSGTDFTLTISSLEPEDFAVYYCQHRYNWLTFGGGTKVEIK | 4294 | QHRYNWLT | KAPPA |
| COV107_6mo_P2_IGG_F4-P1369 | 4295 | QVQLVQSGAEVKKPGSSVKVSCKASGGTFNSYAISWVRQAPGQGLEWMGGIIPIFGTANYAQKFQGRVTITADESTSTAYMELSSLRSEDTAVYFCATTFQWDLLVYWGQGTLVTVSS | 4296 | ATTFQWDLLVY | COV107_6mo_P2_Kappa_F4-P1389 | 4297 | DIQMTQSPSSLSASVGDRVTITCQASQDISNYLNWYQQKPGKAPKLLIYDASNLEIGVPSRFSGSGSGTDFTFTISSLQPEDIATYYCQQYDHLPIFTFGPGTKVDVK | 4298 | QQYDHLPI | KAPPA |

TABLE 9-continued

Sequence pairs of antibody heavy and light chain variable regions from six individuals at 1.3 and 6.2 month time points.

| | | | | | | | | | |
|---|---|---|---|---|---|---|---|---|---|
| COV107_ 6mo_P2_ IGG_ F6- P1369 | 4299 | EVQLVESGGGLVQPGGSLKLSCAASGFTFSGSA MHWVRQASGKGLEWVGRIRNKANSYATAYG ASVRGRFTVSRDDSKNTAYLQMNSLKIEDTAV YYCTKDIAAGIPALNWFDSWGQGTLVTVSS | 4300 | TKDIAA GIPALN WFDS | COV107_ 6mo_P2_ Kappa_ F6- P1389 | 4301 | EIVLTQSPATLSLSPGERATLSCRASQSV SSYLAWYQQKPGQAPRLLIYDASNRAT GIPARFSGSGSGTDFTLTISSLEPEDFAVY YCQQHTNWPPRITFGGGTKVEIK | 4302 | QQH TNW PPRI T | KAPPA |
| COV107_ 6mo_P2_ IGG_ F7- P1369 | 4303 | QVQLVESGGGVVQPGRSLRLSCAASGFTFSNY GIHWVRQAPGKGLEWVAVISYDGSDKYYADS VKGRFTISRDNSKNTLYLQMNSLRAEDTAVYY CAKGGPYGDHVRSDYWGQGTLVTVSS | 4304 | AKGGP YGDHV RSDY | COV107_ 6mo_P2_ Kappa_ F7- P1389 | 4305 | DIQMTQSPSSLSASVGDRVTITCQASQDI SNYLNWYQQKPGKAPKLLIYDASYLET GVPSRFSGSGSGTHFTFTISSLQPEDIATY XSQQYEILPLTFGQGTKM | 4306 | QQY EILP LT | KAPPA |
| COV107_ 6mo_P2_ IGG_ F8- P1369 | 4307 | EVQLVESGGGLVQPGGSLRLSCAASGFTFSSYD MHWVRQATGKRLEWVSLIGTAGDTYYPASVK GRFTISRENAKNSLYLQMNSLRAGDTAVYYCA RVSYYYGSSGYSSYFDLWGRGTLVTVSS | 4308 | ARVSYY YGSSGY SSYFDL | COV107_ 6mo_P2_ Kappa_ F8- P1389 | 4309 | DIQMTQSPSSLSASVGDRVTITCRASQRI SSYLNWYQQKPGKAPKLLIYAASSLQSG VPSRFSGSGSGTDFTLTISSLQPEDFATY YCQQSYSNPPEDTFGQGTKLEIK | 4310 | QQS YSN PPE DT | KAPPA |
| COV107_ 6mo_P2_ IGG_ F9- P1369 | 4311 | QVQLVESGGGLVKPGGSLRLSCTASGFTFSDY YMTWLRQAPGKGLEWVSYISSTSPYTSYADSV KGRFTISRDNARNSVYLQMNSLRAEDTAIYYC ARVPPPQRLHPFDVWGQGTMVTVSS | 4312 | ARVPPP QRLHPF DV | COV107_ 6mo_P2_ Kappa_ F9- P1389 | 4313 | DIQMTQSPSTLSASVGDRVTITCRASQSI SSWLAWYQQKPGKAPKLLIYQASSLES GVPSRFSGSGSGTDFTLTISSLQPDDFAT YYCQQYFRYSWTFGQGTKVEI | 4314 | qqy fry swt | KAPPA |
| COV107_ 6mo_P2_ IGG_ G2- P1369 | 4315 | QVQLVESGGNVVQPGRSLRLSCAASGFTFSNY GMHWIRQAPGKGLEWVAVISYDGSDKYYADS VKGRVTISRDNSKNTLYLQMNSLRAEDTAVYY CAKGGPYGDHVRSDYWGLGTLVTVSS | 4316 | AKGGP YGDHV RSDY | COV107_ 6mo_P2_ Kappa_ G2- P1389 | 4317 | DIQMTQSPSSLSASVGDRVTITCQASQDI SNYLNWYQQKPGKVPKLLIYDASNLET GVPSRFSGSGSGTDFTFTISSLQPEDIATY YCQQFHNLPLTFGQGTKLEIK | 4318 | QQF HNL PLT | KAPPA |
| COV107_ 6mo_P2_ IGG_ G4- P1369 | 4319 | EVQLVESGGGLVKPGRSLRLSCTASGTASGFIF GDYAVNWFRQAPGKGLEWVGFIRSKPYGGTT QYAASVRGRFTISRDDSKSTAYLQMNSLKIEDT AVYYCTQPPGYCSGGRCYFASWGQGTLVTVS | 4320 | TQPPGY CSGGRC YFAS | COV107_ 6mo_P2_ Kappa_ G4- P1389 | 4321 | EIVMTQSPATLSVSPGERATLSCRASQSV SSNLAWYQQKPGQAPRLLIYDSSTRATG IPARFSGSGSGTDFILTISGLQSEDFAVYY CQQYDNWHSFGQGTKVEIK | 4322 | QQY DN WHS | KAPPA |
| COV107_ 6mo_P2_ IGG_ G5- P1369 | 4323 | EVQLVESGGGLIQPGGSLRLSCAASGLTVSSNY MSWVRQAPGKGLEWVSVIYSGGSTFYADSVK DRFTISRDNEKNTLYLQMNSLRAEDTAVYYCA RDLEVAGGFDCWGQGTLVTVSS | 4324 | ARDLEV AGGFDC | COV107_ 6mo_P2_ Kappa_ G5- P1389 | 4325 | DIQLTQSPSFLSASVGDRVTITCRASQGIS SYLAWYQQKPGKAPKLLIYAASTLQSG VPSRFSGSGSGTEFTLTISSLQPEDFATY YCQQLNDYPSITFGQGTRLEIK | 4326 | QQL NDY PSIT | KAPPA |
| COV107_ 6mo_P2_ IGG_ G6- P1369 | 4327 | EVQLVQSGAEVKKPGESLKISCEGSGYRFTTY WIAWVRQMPGKGLEWMGIIYCGDSDTRYNPS FQGEVSISVDKSISTAYLQWSSLKASDTAMYYC ARSRSGIHDAFDMWGQGTMVTVSS | 4328 | ARSRSG IHDAFD M | COV107_ 6mo_P2_ Kappa_ G6- P1389 | 4329 | DIQMTQSPSSLSASVGDRVTITCQASQDI SNYLNWYQQKPGKAPKLLIYDASNLET GVPSRFSGSGSGTDFTFTITSLQPEDIATY YCQQYDNLPLFGPGTKVDIK | 4330 | QQY DNL PL | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_6mo_P2_IGG_H11-P1369 | 4331 | EVQLVESGGGLVQPGGSLRLSCAASGFTFSSYDMHWVRQTTGKRLEWVSVIGTAGDTYYADSVKGRFTISRENAKSSLYLQMNSLRAGDTAVYYCARDIGSIWPQFDPWGQGTLVIVSS | 4332 | ARDIGSIWPQFDP | COV107_6mo_P2_Kappa_H11-P1389 | 4333 | DIQMTQSPSSLSASVGDRVTITCRASQYISSYLNWYQQRSGKAPKLLIYAASTLQSGVPSRFSGSGSGTDFTLTISSLQAEDFATYYCQQSYTTVALTFGGGTKVEIK | 4334 | QQSYTTVALT | KAPPA |
| COV107_6mo_P2_IGG_H3-P1369 | 4335 | EVQLLESGGGLVQPGGSLRLSCAASGFTFSSYAMSWVRQAPGKGLEWVSAISGSGDSTYYADSVKGRFTISRDSSKNTLYLQMNSLRAEDTAVYYCVMRYYDILTGPWTPHWGQGTLVTVSS | 4336 | VMRYYDILTGPWTPH | COV107_6mo_P2_Kappa_H3-P1389 | 4337 | DIQMTQSPSSLSASVGDRVTITCQASQDISNYLNWYQQKPGKAPELLIYDASNLEIGVPSRFSGSGSGTDFTFTISSLQPEDIATYYCQQYDNLPPLTFGGGTKVEIK | 4338 | QQYDNLPPLT | KAPPA |
| COV107_6mo_P2_IGG_H5-P1369 | 4339 | QVQLQESGPGLVKPSETLSLTCTVSGGSISSYYWSWIRQPPGKGLEWIGYIFYSGSTNYNPSLRSRVTISVDTSKNQFSLKLSSLTAADTAVYYCARDLGRSSGWPDAFDIWGRGTMVTVSS | 4340 | ARDLGRSSGWPDAFDI | COV107_6mo_P2_Kappa_H5-P1389 | 4341 | EIVLTQSPATLSLSPGERATLSCRASQSVSSYLDWYQQKAGQPPRLLIYDVSNRATGIPARFSGSGSGTDFTLTISSLEPEDFAVYSCQQRSNWPGTFGQGTKLEIK | 4342 | QQRSNWPGT | KAPPA |
| COV107_6mo_P2_IGG_H6-P1369 | 4343 | QVQLVESGGGVVQAGRSLRLSCAASGFTFSSFGLHWVRQAPGKGLEWVAVISDDGANKYYADSVKGRFTISRDNSKNTLYLQMNSLRADDTAKYYCAKSWWLSENWFDPWGQGTLVTVSS | 4344 | AKSWWLSENWFDP | COV107_6mo_P2_Kappa_H6-P1389 | 4345 | EIVMTQSPATLSVSPGERATLSCRASQSVRSNLAWYQQKPGQAPRLLIYGASTRATGIPARFSGSGSGTDFTLTISSLQSEDFAVYYCQQYNNWPLTFGGGTKVEIK | 4346 | QQYNNWPLT | KAPPA |
| COV107_6mo_P2_IGG_H7-P1369 | 4347 | EVQLVESGGGLVQPGGSLRLSCAASGFTFSSYSMNWVRQAPGKGLEWVSYISSSSSTIYYADSVKGRFTISRDTAKNSLYLQMNSLRDEDTAVYYCARDTGFWSGNFPGLFDYWGQGTLVTVSS | 4348 | ARDTGFWSGNFPGLFDY | COV107_6mo_P2_Kappa_H7-P1389 | 4349 | DIQMTQSPSSLSASVGDRVTITCQASQDISNYLNWYQQKPGKAPKLLIYDASNLETGVPSRFSGSGSGTDFTFTISSLQPEDIATYYCQHYDTLPPVTFGQGTRLDIK | 4350 | QHYDTLPPVT | KAPPA |
| COV107_6mo_P2_IGG_H8-P1369 | 4351 | QVQLVQSGAEVKKPGASVKVSCTASGYTFSSYYIHWVRQAPGQGLEWMGIINPGAGSTSYAQKFQGRVAMTTDTSTRTVYMELSSLRSDDTAVYYCARDEAFLPSAIFVGDYWGQGTLVTVSS | 4352 | ARDEAFLPSAIFVGDY | COV107_6mo_P2_Kappa_H8-P1389 | 4353 | DIQMTQSPSSLSASVGDRVTITCRASQGIRNDLGWYQQKPGKAPKRLIYAASNLQSGVPSRFSGSGSGTEFTLTISSLQPEDFATYYCLQHSTYPHTWTFGQGTKVEIK | 4354 | LQHSTYPHTWT | KAPPA |
| COV107_6mo_P2_IGG_H9-P1369 | 4355 | QVQLQESGPGLVKPSETLSLTCTVSGASISSYYWSWIRQPPGKGLEWIGYIYYSGSTNYNPSLKSRVTISLDTSKNQFSLQLSSVTAADTAVYYCATYYFDNSGYSYGLDVWGQGTTVTVSS | 4356 | ATYYFDNSGYSYGLDV | COV107_6mo_P2_Kappa_H9-P1389 | 4357 | DIQMTQSPSSLSASVGDRVTIACRASQSISSYLHWYQQQPGKAPKLLIYAVTNLQSGVPSRFSGSGSGTDFTLTISSLQPEDFATYYCQQSYSLPQTFGQGTKVEIK | 4358 | QQSYSLPQT | KAPPA |
| COV107_Plate1_HC_10-P1369 | 4359 | QVQLVESGGGVVQPGRSLRLSCAASGFTFSSYAMHWVRQAPGKGLEWVAVILYDGSNKYYADSVKGRFTISRDNSKNTLYLQMNSLRAEDTAVYYCARDQDLDTAMVTLFDYWGQGTLVTVSS | 4360 | ARDQDLDTAMVTLFDY | COV107_Plate1_Kappa_10-P1389 | 4361 | DIQMTQSPSSLSASVRDRVTITCRASQSISSYLNWYQQKPGKAPKLLIYAASSLQSGVPSRFSGSGSGTDFTLTISSLQPEDLATY | 4362 | QQSYSTPPWT | KAPPA |

TABLE 9-continued

Sequence pairs of antibody heavy and light chain variable regions from six individuals at 1.3 and 6.2 month time points.

| | | | | | | | | | |
|---|---|---|---|---|---|---|---|---|---|
| COV107_Plate1_HC_11-P1369 | 4363 | QVQLQQWGAGLLKPSETLSLTCAVSGGSLSGFYWTWIRQPPGKGLEWIGETNHFGSTDYKASLKSRVTISVGMSRNQFSLKVTSLTAADTAVYYCARKPLLYSDFSPGAFDIWGQGTMIVVSS | 4364 | ARKPLLYSDFSPGAFDI | COV107_Plate1_Kappa_11-P1389 | 4365 | EIVLTQSPGTLSLSPGERATLSCRASQTLTANYLAWYQQKPGQAPRLLIYGASKRAAGIPDRFSGSGSGTDFTLSITRLEPEDFAVYYCQQYHTTPRTFGGGTKVEI | 4366 | QQYHTTPRT | KAPPA |
| COV107_Plate1_HC_15-P1369 | 4367 | EVQLVESGGGLIQPGGSLRLSCAASGLTVSSNYMSWVRQAPGKGLEWVSVLYSGGSSFYADSVKGRFTISRDNSKNTLYLQMNSLRAEDTAVYYCARESGDTTMAFDYWGQGTLVTVSS | 4368 | ARESGDTTMAFDY | COV107_Plate1_Kappa_15-P1389 | 4369 | DIQLTQSPSFLSASVGDRVTITCRASQGISSYLAWYQQKPGKAPKLLIYAASTLQVPSRFSGSGSGTEFTLTISSLQPEDFATYYCQQLNSDSYTFGQGTKLEIK | 4370 | QQLNSDSYT | KAPPA |
| COV107_Plate1_HC_16-P1369 | 4371 | QVQLVESGGGVVQPGRSLRLSCAASGFTFSTYGMHWVRQAPGKGLEWVAVISYDGSNKYYADSVKGRFTISRDNSKNTLYLQMNSLRAEDTAVYYCAKGGLYDSSGYYPHYGMDVWGQGTTVTVSS | 4372 | AKGGLYDSSGYYPHYGMDV | COV107_Plate1_Kappa_16-P1389 | 4373 | DIQMTQSPSSLSASVGDRVTITCQASQDINNYLNWYQQKPGKAPKVLIYDASNLETGVPSRFSGSGSGTDFTFTISSLQPEDFATYYCQQYDNLPLAFGGGTKVEIK | 4374 | QQYDNLPLA | KAPPA |
| COV107_Plate1_HC_18-P1369 | 4375 | EVQLVESGGGLIQPGGSLRLSCAASGVTVSRNYMSWVRQAPGKGLEWVSVIYSGGSTYYADSVKGRFTISRDNSKNTLYLQMNSLRAEDTAVYYCARDLSAAFDIWGQGTMVTVSS | 4376 | ARDLSAAFDI | COV107_Plate1_Kappa_18-P1389 | 4377 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPAFGQGTRLEIK | 4378 | QQLSNYPPA | KAPPA |
| COV107_Plate1_HC_19-P1369 | 4379 | QVQLVESGGGVVQPGRSLRLSCAASGFTFSNFGMHWVRQAPGKGLEWVAVIWYDGSNKYYADSVKGRFTISRDNSKNTLYLQMNSLRAEDTAVYYCARGVNPDDILTGVDAFDIWGQGTMVTVSS | 4380 | ARGVNPDDILTGVDAFDI | COV107_Plate1_Kappa_19-P1389 | 4381 | DIQMTQSPSTLSASVGDRVTITCRASQSMSSWLAWYQQKPGNAPKLLIYKASSLESGVPSRFSGSGSGTEFTLTISSLQPDDFATYYCQQHNSSPLTFGGGTKVEIK | 4382 | QQHNSSPLT | KAPPA |
| COV107_Plate1_HC_21-P1369 | 4383 | QVQLVQSGAEVVRPGASVKVSCKASGYTFTTHYMHWVRQAPGQGLEWMGIINPSVGSTSYAQKFQGRVTMTRDTSTSTVYMELSSLISEDTAMYYCARGPRSPSDWCSGGSCYDDQNWFDPWGQGTLVTVSS | 4384 | ARGPRSPSDWCSGGSCYDDQNWFDP | COV107_Plate1_Kappa_21-P1389 | 4385 | DIQMTQSPSSLSASVGDRVTITCRASQSISSYLNWYQQKPGKAPKLLIYSASSLQSGVPSRFSGSGSGTDFTLTISSLQPEDFATYYCQQSYSTLITFGQGTRLEIK | 4386 | QQSYSTLIT | KAPPA |
| COV107_Plate1_HC_24-P1369 | 4387 | QVQLVQSGAEVMKPGASVKVSCKASGYTFTSYYMHWVRQAPGQGLEWMGIINPTAGSTSYAQKFQGRVTMTRDTSTSTVYMELSSLRSEDTAVYYCARDFELWFGELRGWFDPWGQGTLVTVSS | 4388 | ARDFELWFGELRGWFDP | COV107_Plate1_Kappa_24-P1389 | 4389 | EIVMTQSPATLSVSPGERATLSCRASQSVSSNLAWYQQKPGQAPTLLIYGASTRATGIPARFSGSGSGTEFTLTISSLQSEDFAVYYCQQYNNWPPITFGQGTRLEIK | 4390 | QQYNNWPPIT | KAPPA |
| COV107_Plate1_HC_2-P1369 | 4391 | EVQLVESGGGLVQPGGSLRLSCAASGFTFSGYSMNWVRQAPGKGPEWVSYISRSSSTIYYADSVKGRFTISRDNAKNSLYLQMNSLRDEDTAVYYCAREGARVGATYDTYYFDYWGQGTLVTVSS | 4392 | AREGARVGATYDTYYFDY | COV107_Plate1_Kappa_2-P1389 | 4393 | EIVLTQSPATLSLSPGERATLSCRASQSFSSYLAWYQQKPGQAPRLLIYDASNRATGIPARFSGSGSGTDFTLTISSLEPEDFAVYYCQQRNNWPPEWTFGQGTKVEIK | 4394 | QQRNNWPPEWT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_Plate1_HC_30-P1369 | 4395 | EVQLVESGGGLIQPGGSLRLSCAASGFTVSSNYMSWVRQAPGKGLEWVSLIYSGGSTYYADSVKGRFTISRDNSKNTLYLQMNSLRAEDTAVYYCARTDIVVVPAARGFYFDYWGQGTLVTVSS | 4396 | ARTDIVVVPAARGFYFDY | COV107_Plate1_Kappa_30-P1389 | 4397 | DIQMTQSPSTLSASVGDRVTITCRASQSISSWLAWYQQKPGKAPKLLIYKASSLESGVPSRFSGSGSGTEFTLTISSLQPDDFATYYCQQYNSYGTFGQGTKVEIK | 4398 | QQYNSYGT | KAPPA |
| COV107_Plate1_HC_36-P1369 | 4399 | EVQLVESGGGLIQPGGSLRLSCAASGFIVSSNYMSWVRQAPGKGLEWVSVIYSGGSTYYADSVKGRFTISRDNSKNTLYLQMNSLRVEDTAVYYCARDYGDYYFDYWGQGTLVTVSS | 4400 | ARDYGDYYFDY | COV107_Plate1_Kappa_36-P1389 | 4401 | EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPRTFGQGTKVEIK | 4402 | QQYGSSPRT | KAPPA |
| COV107_Plate1_HC_37-P1369 | 4403 | EVQLVQSGAEVKKPGESLKISCKGSGYSFTSYWIGWVRQMPGKDLEWMGIIYPGDSDTRYSPSFQGQVTISADKSISTAYLQWSSLKASDTAMYYCALTTVTTGRWFDPWGQGTLVTVSS | 4404 | ALTTVTTGRWFDP | COV107_Plate1_Kappa_37-P1389 | 4405 | DVVMTQSPLSLPVTLGQPASISCRSSQSLVYSDGNTYLNWFQQRPGQSPRRLIYQVSNRDSGVPDRFSGSGSGTDFTLKISRVEAEDVGVYYCMQGTHWLWTFGQGTKVEIK | 4406 | MQGTHWLWT | KAPPA |
| COV107_Plate1_HC_38-P1369 | 4407 | QVQLVESGGGVVQPGRSLRLSCAASGFTFSNFGMHWVRQAPGKGLEWVAVIWYDGSNKYYADSVKGRFTISRDNSKNTLYLQMNSLRAEDTAVYYCARGVNPDDILTGVDAFDIWGQGTMVTVSS | 4408 | ARGVNPDDILTGVDAFDI | COV107_Plate1_Kappa_38-P1389 | 4409 | DIQMTQSPSTLSASVGDRVTITCRASQSMSSWLAWYQQKPGNAPKLLIYKASSLESGVPSRFSGSGSGTEFTLTISSLQPDDFATYYCQQHNSSPLTFGGGTKVEIK | 4410 | QQHNSSPLT | KAPPA |
| COV107_Plate1_HC_39-P1369 | 4411 | EVQLVQSGAEVKKPGESLRISCKGSGYSFTSYYISWVRQMPGKGLEWMGRIDPSDSYTNYSPSFQGHVTISADKSISAAYLQWSSLKASDTAMYYCARHRHPGITMIVALDYWGQGTLVTVSS | 4412 | ARHRHPGITMIVALDY | COV107_Plate1_Kappa_39-P1389 | 4413 | DIQMTQSPSSLSASVGDRVTITCQASQDISNYLNWYQQKPGKAPKLLIYDASYLETGVPSRFTGSASGTDFTFTISSLQPEDIATYYCQQYDNVPLFGPGTKVDI | 4414 | QQYDNVPL | KAPPA |
| COV107_Plate1_HC_40-P1369 | 4415 | EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDWGEYYFDYWGQGTLVTVSS | 4416 | ARDWGEYYFDY | COV107_Plate1_Kappa_40-P1389 | 4417 | EIVLTQSPGTLSLSPGERATLSCRASQSVTSYLAWYQQKPGQAPRLLIYGASSRATGIPDRFSGSGSGTDFTLTISRLDPEDFAVYYCQQYGSSPRTFGQGTKVEIK | 4418 | QQYGSSPRT | KAPPA |
| COV107_Plate1_HC_42-P1369 | 4419 | QVQLQQWGAGLLKPSETLSLSCAVYGGSLSGYYWSWIRQPPGKGLEWIGEINHFGSTGYNPSLKSRVTISVDTSKSQFSVKLSSVTAADTAVYYCARKPLLYSNLSPGAFDIWGQGTMVTVSS | 4420 | ARKPLLYSNLSPGAFDI | COV107_Plate1_Kappa_42-P1389 | 4421 | EIVLTQSPGTLSLSPGERATLSCWASQSVSASYLAWYQQKPGQAPRLLIYGASSRATGIPDRFSGSGSGTDFTLTISRLEPEDFAVYYCQQYGTTPRTFGGGTKVEIK | 4422 | QQYGTTPRT | KAPPA |
| COV107_Plate1_HC_43-P1369 | 4423 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKAGYSYGYPQQYFDYWGQGTLVTVSS | 4424 | AKAGYSYGYPQQYFDY | COV107_Plate1_Kappa_43-P1389 | 4425 | DIQMTQSPSTLSASVGDRVTITCRASQSISSWLAWYQQKPGKAPKLLISEASSLESGVPSRFSGSGSGTEFTLTISSLQPDDFATYYCQQYNSYSYTFGQGTKLEIK | 4426 | QQYNSYSYT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_Plate1_HC_44-P1369 | 4427 | EVQLVESGGGLIQPGGSLRLSCAASGFTVSSNYMSWVRQAPGKGLEWVSVIYSGGSTFYADSVKGRFTISSDNSKNTLYLQMNSLRAEDTAVYYCARDLRGPGTFDIWGQGTMVTVSS | 4428 | ARDLRGPGTFDI | COV107_Plate1_Kappa_44-P1389 | 4429 | DIQMTQSPSSLSASVGDRVTITCQASQDISNYLNWYQQKPGKAPKLLIYDASNLETGVPSRFSGSGSGTDFTFTISSLQPEDIATYYCQQYDNLPRVTFGPGTKVDIK | 4430 | QQYDNLPRVT | KAPPA |
| COV107_Plate1_HC_45-P1369 | 4431 | EVQLVQSGAEVKKPGESLRISCKGSAYIFTTYWISWVRQMPGKGLEWMGRIDPSDSYTNYSPSFQGHVTISADKSISTAYLQWSSLKASDTAMYYCARHISSGWYDYWGQGTLVTVSS | 4432 | ARHISSGWYDY | COV107_Plate1_Kappa_45-P1389 | 4433 | DIQMTQSPSSLSASVGDRVTITCQASQDISNYLNWYQQKPGKAPKLLIYDASNLETGVPSRFSGSKSGTDFTFTISSLQPEDIATYYCQQYDNLPYTFGQGTKVEI | 4434 | QQYDNLPYT | KAPPA |
| COV107_Plate1_HC_53-P1369 | 4435 | QMQLVQSGPEVKKPGTSVKVSCKASGFTFTSSAVQWVRQARGQRLEWIGWIVVGSGNTNYVQKFQERVTITRDMSTSTAYMELSSLRSEDTAVYYCAAPHCSSTSCFDAFDIWGQGTMVTVSS | 4436 | AAPHCSSTSCFDPWT | COV107_Plate1_Kappa_53-P1389 | 4437 | EIVLTQSPGTLSLSPGERATLSCRASQSVSSSYLAWYQQKPGQAPRLLIYGASSRATGIPDRFSGSGSGTDFTLTISRLEPEDFAVYYCQQYGNSPWTFGQGTKVEIK | 4438 | QQYGNSPWT | KAPPA |
| COV107_Plate1_HC_59-P1369 | 4439 | EVQLVESGGGLIQPGGSLRLSCAASGFIVSSNYMSWVRQAPGKGLEWVSIIYSGGSTFYADSVKGRFTISRDNSKNTLYLQMNSLRAEDTAVYYCARTMDGDYFDYWGQGTLVTVSS | 4440 | ARTMDGDYFDY | COV107_Plate1_Kappa_59-P1389 | 4441 | DIQMTQSPSSLSASVGDRVTITCRASQDINNYLAWYQQKPGKVPKLLIYAASTLQSGVPSRFSGSGSGTDFTLTISSLQPEDVATFYCQKYNSAPLTFGGGTKVEIK | 4442 | QKYNSAPLT | KAPPA |
| COV107_Plate1_HC_65-P1369 | 4443 | QVQLVESGGGVVQPGRSLRLSCAASGFTFSSYAIHWVRQAPGKGLEWVAVISYDGSNKYYADSVKGRFTISRDNSKNTLYLQMNSLRADDTAVYYCARDSPSQIVVVPVFDYWGQGTLVTVSS | 4444 | ARDSPSQIVVVPVFDY | COV107_Plate1_Kappa_65-P1389 | 4445 | DIQMTQSPSSLSASVGDRVTITCRASQSISRYLNWYQQKPGKAPNLLIYAASSLQSGVPSRFSGSGSGTDFTLIISSLQPEDFATYYCQQSYSTLALTFGGGTKVEIK | 4446 | QQSYSTLALT | KAPPA |
| COV107_Plate1_HC_74-P1369 | 4447 | EVQLVESGGGLVQPGRSLRLSCAASGFTFDDYAMHWVRQAPGKGLEWVSGVSWNSGSIGYADSVRGRFTISRDNAKNSLYLQMNSLRAEDTALYYCAKALSSTGFLVVYFDYWGRGTLVTVSS | 4448 | AKALSSTGFLVVYFDY | COV107_Plate1_Kappa_74-P1389 | 4449 | EIVMTQSPATLSVSPGERATLSCRASQSVSSNLAWYQQKPGQAPRLLIYGASTRATGIPARFSGSGSGTEFTLTISSLQSEDFAVYYCQQYNNWLSLTFGGGTKVEIK | 4450 | QQYNNWLSLT | KAPPA |
| COV107_Plate1_HC_75-P1369 | 4451 | EVQLVQSGAEVKKPGESLKISCKGSGYRFTSYWIGWVRQMPGKGLEWMGIIYPGDSDATYSPSFQGQVTISADRSISTAYLQWSSLKASDTAMYYCARSFRDDPRIAVAGPADAFDIWGQGTMVTVSS | 4452 | ARSFRDDPRIAVAGPADAFDI | COV107_Plate1_Kappa_75-P1389 | 4453 | DIQMTQSPSTLSASVGDRATITCRASQSISYWLAWYQQKPGKAPKLLIYKASSLESGVPSRFSGSGSGTEFTLTISSLQPDDSATYYCQQYNSYPYTFGQGTKLEIK | 4454 | QQYNSYPYT | KAPPA |
| COV107_Plate1_HC_78-P1369 | 4455 | QVQLVQSGAEVKKSGSSVKVSCKASGGTFSSYGISWVRQAPGQGLEWMGGIIPIIGTANYAQKFQGRVTITADESMSTAYMELSSLRSEDTAVYYCARAGLLTKNIVATIGCFDPWGQGTLVTVSS | 4456 | ARAGLLTKNIVATIGCFDP | COV107_Plate1_Kappa_78-P1389 | 4457 | DIVMTQSPDSLAVSXGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK | 4458 | QQYYSTPLT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_Plate1_HC_7-P1369 | 4459 | QVQLVQSGAEVKKPGASVKVSCKASGYTFTSYGITWVRQAPGQGLQWMGWISAYNGNTNYAQKLQGRVTMTTDTSTSTAYMELRSLRSDDTAVYYCARVGHARGVITGGDYFYYGMDVWGQGTTVTVSS | 4460 | ARVGHARGVITGGDYFYYGMDV | COV107_Plate1_Kappa_7-P1389 | 4461 | EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPTFGGGTKVEIK | 4462 | QQYGSSPT | KAPPA |
| COV107_Plate1_HC_80-P1369 | 4463 | EVQLLESGGGLVQPGGSLRLSCAASGITFSSYAMTWVRQAPGKGLEWVSTISGSGGGTYYADSVKGRFTISRDNSKNTLYLQMNSLRAEDTAVYYCVETNLWFGEDNYYYYYGMDVWGQGTTVTVSS | 4464 | VETNLWFGEDNYYYYYGMDV | COV107_Plate1_Kappa_80-P1389 | 4465 | EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPPWTFGQGTKVEIK | 4466 | QQYGSSPPWT | KAPPA |
| COV107_Plate1_HC_82-P1369 | 4467 | EVQLVESGGGLIQPGGSLRLSCAASGFIVSSNYMSWVRQAPGKGLEWVSVIYSGGSTYYADSVKGRFTISRDNSKNTLYLQMNSLRAEDTAVYYCARDYGDFYFDYWGQGTLVTVSS | 4468 | ARDYGDFYFDY | COV107_Plate1_Kappa_82-P1389 | 4469 | EIVMTQSPATLSVSPGERATLSCRASQSVSSNLAWYQQKPGQAPRLLIYGASTRATGIPARFSGSGSGTEFTLTISSLQSEDFAVYYCQQYYNWPRTFGQGTKVEIK | 4470 | QQYYNWPRT | KAPPA |
| COV107_Plate1_HC_84-P1369 | 4471 | QVQLQQWGAGLLKPSETLSLTCAVSGGSLSGFYWTWIRQPPGKGLEWIGETNHFGSTDYKPSLKSRVTISVDMSRNQFSLIMTSVTAADTAVYYCARKTLLFSDFSPGAFDIWGQGTMVVVSS | 4472 | ARKTLLFSDFSPGAFDI | COV107_Plate1_Kappa_84-P1389 | 4473 | EIVLTQSPGTLSLSPGERATLSCRASQTLTANYLAWYQQKPGQAPRLLIYGASKRATGIPDRFSGSGSGTDFTLSISRLEPEDFAVYYCQQYGTTPRTFGGGTKVEI | 4474 | QQYGTTPRT | KAPPA |
| COV107_Plate1_HC_86-P1369 | 4475 | EVQLVESGGGLIQPGGSLRLSCAASGFTVSSNYMSWVRQAPGKGLEWVSVIYSGGSTYYADSVKGRFTISRDNSKNTLYLQMNSLRADDTAVYYCATDLTSGRGPWGQGTLVTVSS | 4476 | ATDLTSGRGP | COV107_Plate1_Kappa_86-P1389 | 4477 | AIQMTQSPSSLSASVGDRVTITCRASQGIRNDLGWYQQKPGKAPKLLIYAASSLQSGVPSRFSGSGSGTDFTLTISSLQPEDFATYYCLQDYNYPKTFGQGTKVEIK | 4478 | LQDYNYPK | KAPPA |
| COV107_Plate1_HC_88-P1369 | 4479 | EVQLVESGGGLIQPGGSLRLSCAASGLTVSSNYMSWVRQAPGKGLEWVSVIYSGGSTFYADSVKGRFTISRDNSKNTLYLQMNSLRAEDTAVYYCAREVAAFDIWGQGTMVTVSS | 4480 | AREVAAFDI | COV107_Plate1_Kappa_88-P1389 | 4481 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPGFGQGTKVEIK | 4482 | QQLNSYPPG | KAPPA |
| COV107_Plate1_HC_93-P1369 | 4483 | QVQLQESGPGLVKPSQTLSLTCTVSGGSISSGGYYWSWIRQHPGKGLEWIGYIYYSGSTYYNPSLKSRVTISVDTXKNQFSLKLSSVTAADTAVYYCAWRYSSSWYTVDNKKGDYYFDYWGQGTLVTVSS | 4484 | AWRYSSSWYTVDNKKGDYYFDY | COV107_Plate1_Kappa_93-P1389 | 4485 | DIVMTQSPLSLPVTPGEPASISCRSSESLLHSNGYNYLDWYLQKPGQSPQLLIYLGSNRASGVPDRFSGSGSGTDFTLKISRVEAEDVGVYYCMQALQTPRTFGQGTKLEIK | 4486 | MQALQTPRT | KAPPA |
| COV107_Plate1_HC_95-P1369 | 4487 | QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGRYCSSTSCYSHVGFDPWGQGTLVTVSS | 4488 | ARGGRYCSSTSCYSHVGFDP | COV107_Plate1_Kappa_95-P1389 | 4489 | DIQLTQSPSFLSASVGDRVTITCRASQGISSYLAWFQQKPGKAPKLLIYAASTLQTGVPSRFSGSGSGTEFTLTISSLQPEDFATYYCQQLNSYPITFGQGTRLEIK | 4490 | QQLNSYPIT | KAPPA |

TABLE 9-continued

Sequence pairs of antibody heavy and light chain variable regions from six individuals at 1.3 and 6.2 month time points.

| | | | | | | | | | |
|---|---|---|---|---|---|---|---|---|---|
| COV107_Plate1_HC_9-P1369 | 4491 | EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDWGEYYFDYWGQGTLVTVSS | 4492 | ARDWGEYYFDY | COV107_Plate1_Kappa_9-P1389 | 4493 | EIVLTQSPGTLSLSPGERATLSCRASQSVTSYLAWYQQKPGQAPRLLIYGASSRATGIPDRFSGSGSGTDFTLTISRLDPEDFAVYYCQQYGSSPRTFGQGTKVEIK | 4494 | QQYGSSPRT | KAPPA |
| COV107_Plate2_HC_11-P1369 | 4495 | EVQLVESGGGLVQPGGSLRLSCAASGFTFSSYSMNWVRQAPGKGLEWVSYISTSSSTIYYADSVQGRFTISRDNAKNSLYLQMNSLRDEDTAVYYCARDQGYCSSTSCYDGYYYYMDVWGKGTTVTVSS | 4496 | ARDQGYCSSTSCYDGYYYYMDV | COV107_Plate2_kappa_11-P1389 | 4497 | DIQMTQSPSSLSASVGDRVTITCRASQSISSYLNWYQQKPGKAPKLLIYAASSLHSGVPSRFSGSGSGTDFTLTISSLQPEDFATYYCQQSYSAPWTFGQGTKVEIK | 4498 | QQSYS | KAPPA |
| COV107_Plate2_HC_13-P1369 | 4499 | EVQLVESGGGLIQPGGSLRLSCAASGFIVSSNYMSWVRQAPGKGLEWVSVIYSGGSTFYADSVKGRFTISRDNSKNTLYLQMNSLRAEDTAVYYCARDYGDYYFDYWGQGTLVTVSS | 4500 | ARDYGDYYFDY | COV107_Plate2_kappa_13-P1389 | 4501 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIK | 4502 | QQYGSSPRT | KAPPA |
| COV107_Plate2_HC_15-P1369 | 4503 | EVQLVESGGGLIKPGRSLRLSCTASGFTFGDYAMTWFRQAPGKGLEWVGFIRSKAYGGTTGYAASVKYRFTISRDDSKSIAYLQMDSLKTEDTAVYYCTRWDGWSQHDYWGQGTLVTVSS | 4504 | TRWDGWSQHDY | COV107_Plate2_kappa_15-P1389 | 4505 | DIVMTQSPLSLSVTPGEPASISCRSSQSLLHSNGNNYFDWYLQKPGQSPQLLIYLGSNRASGVPDRFSGSGSGTDFTLKISRVEAEDVGVYYCMQVLQIPYTFGQGTKLEI | 4506 | MQVLQIPYT | KAPPA |
| COV107_Plate2_HC_17-P1369 | 4507 | QVQLVQSGAEVKKPGSSVKVSCKASGGTFSIYAISWVRQAPGQGLEWMGGIIPILGTANYAQKFQGRVTITADESTSTAYMELSSLRSEDTAVYYCASFHVAYGDYIPFDYWGQGTLVTVSS | 4508 | ASFHVAYGDYIPFDY | COV107_Plate2_kappa_17-P1389 | 4509 | EIVLTQSPGTLSLSPGERATLSCRASQSVSSSYLAWYQQKPGQAPRLLIYGASSRATGIPDRFSGSGSGTDFTLTISRLEREDFAVYYCQQYGRSPTWTFGQGTKVEIK | 4510 | QQYGRSPTWT | KAPPA |
| COV107_Plate2_HC_18-P1369 | 4511 | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAREPQINPYYDILTGYRAFDYWGQGTLVTVSS | 4512 | AREPQINPYYDILTGYRAFDY | COV107_Plate2_kappa_18-P1389 | 4513 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGQGTRLEIK | 4514 | QQYGSSLT | KAPPA |
| COV107_Plate2_HC_23-P1369 | 4515 | EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDLGTGLFDYWGQGTLVTVSS | 4516 | ARDLGTGLFDY | COV107_Plate2_kappa_23-P1389 | 4517 | DIQLTQSPSFLSASVGDRVTITCRASQGISSYLAWYQQKPGKAPKLLIYAASTLQSGVPSRFSGSGSGTEFTLTISSLQPEDFATYYCQQLDSYPPGTFGPGTKVDIK | 1548 | QQLDSYPPGT | KAPPA |
| COV107_Plate2_HC_31-P1369 | 4519 | QVQLQQWGAGLLKPSETLSLTCAVSGGSLSGFYWTWIRQPPGKGLEWIGETNHFGSTDYKPSLKSRVTISVDMSRNQFSLKVTSVTAADTAVYYCARKPLLHSDLSPGAFDIWGQGTMVAVSS | 4520 | ARKPLLHSDLSPGAFDI | COV107_Plate2_kappa_31-P1389 | 4521 | EIVLTQSPGTLSLSPGERATLSCRASQTVSANYLAWYQQKAGQAPRLLIYGASKRATGIPDRFSGSGSGTDFTLSISRLEPEDFAVYYCQQYVTTPRTFGGGTKVEI | 4522 | QQYVTTPRT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_Plate2_HC_32-P1369 | 4523 | EVQLVESGGGLIQPGGSLRLSCAASGFTVSSNYMTWVRQAPGKGLEWVSLIYPGGSTYYADSVKGRFTISRDNSKNTLYLQMNSLRAEDTAVYYCAREGMGMAAAGTWGQGTLVTVSS | 4524 | AREGMGMAAAGT | COV107_Plate2_kappa_32-P1389 | 4525 | DIQMTQSPSSLSASVGDTVTITCQASQDISKYLNWYQQKPGKAPKLLIYDASNLETGVPSRFSGSGSGTDFTFTISSLQPEDIATYYCQQYDNLPQTFGGGTKVEIK | 4526 | QQYDNLPQT | KAPPA |
| COV107_Plate2_HC_38-P1369 | 4527 | EVQLVESGGGLVQPGGSLRLSCAASGFTFSNYDMHWVRQATGRGLEWVSTIGTAGDTYYPGSVKGRFTISRENAKNSLYLQMNSLRAGDTALYYCARVRYDSSGYFWSLDYWGQGTLVTVSS | 4528 | ARVRYDSSGYFWSLDY | COV107_Plate2_kappa_38-P1389 | 4529 | DIQMTQSPSSLSASVGDRVTITCRASQSISRYLNWYQQKPGKAPKLLIYAASSLQSGVPSRFSGSGSGTDFTLTISGLQPEDFATYYCQQSYSTPQYTFGQGTKLEIK | 4530 | QQSYSTPQYT | KAPPA |
| COV107_Plate2_HC_3-P1369 | 4531 | QVQLVESGGGVVQPGRSLRLSCAASGFTFSSYGMHWVRQAPGKGLEWVAVILYDGSNKYYADSVKGRFTISRDNSKNTLYLQMNSLRAEDTAVYYCAKSLGPYCSGGNCYSSYFDYWGQGTLVTVSS | 4532 | AKSLGPYCSGGNCYSSYFDY | COV107_Plate2_kappa_3-P1389 | 4533 | DIQMTQSPSTLSASVGDRVTITCRASQSISSWLAWYQQKPGKAPKLLIYEASSLESGVPSRFSGSGSGTEFTLTISSLQPDDFATYYCQQYNSYSTFGPGTKVDIK | 4534 | QQYSNYST | KAPPA |
| COV107_Plate2_HC_44-P1369 | 4535 | QVQLVESGGGVVQPGRSLRLSCAASGFTFSSYGMHWVRQAPGKGLEWVAVISYDGSNKYYGDSVKGRFTISRDNSKNTLYLQMNSLRAEDTAVYYCAKKGGGAYCGGDCYLGEFDYWGQGTLVTVSS | 4536 | AKKGGGAYCGGDCYLGEFDY | COV107_Plate2_kappa_44-P1389 | 4537 | EIVLTQSPGTLSLSPGERATLSCRASQSVSSSYLAWYQQKPGQAPRLLIYGASSRATGIPDRFSGSGSGTDFTLTISRLEPEDFAVFYCQQYGTSPSTFGQGTKVESK | 4538 | QQYGT | KAPPA |
| COV107_Plate2_HC_50-P1369 | 4539 | EVQLVESGGGLVQPGRSLRLSCAASGFTFDDYAIHWVRQAPEKGLEWVSGINWSSGSIVYADSVKGRFTISRDNAKNSLYLQMNSLRAEDTALYYCAKGLIAELVGGGWYFDYWGQGTLVTVSS | 4540 | AKGLIAELVGGGWYFDY | COV107_Plate2_kappa_50-P1389 | 4541 | EIVLTQSPATLSLSPGERATLSCRASQSVSSYLAWYQQKPGQAPRLLIYDASNRATGIPARFSGGGSGTDFTLTISSLEPEDFAVYYCQQRSNWPPLTFGQGTKVEIK | 4542 | QQRSNWPP | KAPPA |
| COV107_Plate2_HC_51-P1369 | 4543 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKQAGPYCSGGTCYPGTLDYWGQGTLVTVSS | 4544 | AKQAGPYCSGGTCYPGTLDY | COV107_Plate2_kappa_51-P1389 | 4545 | DIQMTQSPSSLSASVGDRVTITCQASQDISNYLNWYQQKPGKAPKLLIYDASNLETGVPSRFSGSGSGTDFTFTISSLQPEDIATYYCQQYDNVPLTFGPGTKVDIK | 4546 | QQYDNVPLT | KAPPA |
| COV107_Plate2_HC_53-P1369 | 4547 | QVQLQQWGAGLLKPSETLSLTCAVSGGSLSGFYWTWIRQPPGKGLEWIGETNHFGSTGYKPSLKSRVTISVDMSRNQFSLKVTSVTAADTAVYYCARKPLLYSDFSPGAFDIWGQGTMVAVSS | 4548 | ARKPLLYSDFSPGAFDI | COV107_Plate2_kappa_53-P1389 | 4549 | EIVLTQSPGTLSLSPGERATLSCRASQTVTANYLAWYQQKPGQAPRLLIYGASKRATGIPDRFSGSGSGTDFTLSISRLEPEDFAVYYCQQYTTTPRTFGGGTKVEI | 4550 | QQYTTTPRT | KAPPA |
| COV107_Plate2_HC_61-P1369 | 4551 | EVQLVESGGGLVQPGGSLRLSCAASGFTFSSYDMHWVRQATGKGLEWVSTIGTAGDTYYPGSVKGRFTISRENAKNSLYLQMNSLRAGDTAVYFCARGVSGVVRGVIRSFYYYGLDVVVGQGTTVTVSS | 4552 | ARGVSGVVRGVIRSFYYYGLDV | COV107_Plate2_kappa_61-P1389 | 4553 | DIQMTQSPSSLSASVGDRVTITCRASQSISSYLNWYQQKPGKAPKLLIYAASSLQSGVPSRFSGSGSGTDFTLTISSLQPEDFATYYCQQSYITPGWTFGQGTKVEIK | 4554 | QQSYITPGWT | KAPPA |

TABLE 9-continued

Sequence pairs of antibody heavy and light chain variable regions from six individuals at 1.3 and 6.2 month time points.

| | | | | | | | | | | |
|---|---|---|---|---|---|---|---|---|---|---|
| COV107_Plate2_HC_64-P1369 | 4555 | EVQLVESGGDLVQPGGSLRLSCAASGFTFSSYSMNWVRQAPGKGLEWVSYISISSSTIYYADSVKGRFTISRDNAKNSLYLQMNSLRDEDTAVYYCARVAIRVVVPSATYYFDYWGQGTLVTVSS | 4556 | ARVAIRVVVPSTYYFDY | COV107_Plate2_kappa_64-P1389 | 4557 | EIVLTQSPATLSLSPGERATLSCRASQSFSSYLAWYQQKPGQAPRLLIYDASNRATGIPARFSGSGSGTDFTLTISSLEPEDFAFYYCQQRSNWPQGFTFGPGTKVDIK | 4558 | QQRSNWPQGFT | KAPPA |
| COV107_Plate2_HC_68-P1369 | 4559 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCATGGGSYFSPRIYFDYWGQGTLVTVSS | 4560 | ATGGGSYFSPRIYFDY | COV107_Plate2_kappa_68-P1389 | 4561 | DIQMTQSPSSLSASVGDRVTITCQASQDISNYLNWYQQKPGKAPKLLIYDASNLETGVPSRFSGSGSGTDFTFTISSLQPEDIATYYCQQYDNLPPYTFGQGTKLEIK | 4562 | QQYDNLPPYT | KAPPA |
| COV107_Plate2_HC_69-P1369 | 4563 | EVQLVESGGGLIKPGRSLRLSCTASGFTFGDYAMTWFRQAPGKGLEWVGFIRSKAYGGTTGYAASVRYRFTISRDDSSGIAYLQMDSLKTEDTAVYYCTRWDGWSQHDYWGQGTLVTVSS | 4564 | TRWDGWSQHDY | COV107_Plate2_kappa_69-P1389 | 4565 | DIVMTQSPLSLPVTPGEPASISCRSSQSLLQSNGNNYFDWYLQKPGQSPQLLIYLGSNRASGVPDRFSGSGSGTDFTLKISRVEAEDVGVYYCMQVLQVPYTFGQGTNLEI | 4566 | MQVLQVPYT | KAPPA |
| COV107_Plate2_HC_73-P1369 | 4567 | EVQLVESGGGLIQPGGSLRLSCAASGFTVSSNYMSWVRQAPGKGLEWVSLIYPGGSTYFADSVKGRFTISRDNSKNTLYLQMNSLRAEDTAVYYCAREGMGIAAAGTWGQGTLVTVSS | 4568 | AREGMGIAAAGT | COV107_Plate2_kappa_73-P1389 | 4569 | DIQMTQSPSSLSASVGDTVTITCQASQDISKYLNWYQQKPGKAPKLLIYDASNLETGVPSRFSGSGSGTDFTFTISSLQPEDIATYYCQQYDNLPQTFGGGTKVEIK | 4570 | QQYDNLPQT | KAPPA |
| COV107_Plate2_HC_76-P1369 | 4571 | QVQLVESGGGVVQPGRSLRLSCAASGFTFSSYGMHWVRQAPGKGLEWVAVISDDGSNKYYADSVKGRFTISRDNSKNTLYLQMNSLRAEDTAVYYCAKSWWLSENWFDPWGQGTLVTVSS | 4572 | AKSWWLSENWFDP | COV107_Plate2_kappa_76-P1389 | 4573 | EIVMTQSPATLSVSPGERATLSCRASQSVSSNLAWYQQKPGQAPRLLIYGASTRATGIPARFSGTGSGTEFTLTISSLQSEDFAVYYCQQYNNWPLTFGGGTKVEIK | 4574 | QLLNSYPYT | KAPPA |
| COV107_Plate2_HC_78-P1369 | 4575 | EVQLVESGGGLIQPGGSLRLSCAASGFTVSSNYMTWVRQAPGKGLEWVSVIYSGGTTYYADSVKGRFTISRDNSKNTLYLQMNSLRAEDTAVYYCARDLVVWGMDVWGQGTTVTVSS | 4576 | ARDLVVWGMDV | COV107_Plate2_kappa_78-P1389 | 4577 | DIQLTQSPSFLSASVGDRVTITCRASQGISSYLAWYQQKPGKAPKLLIYAASTLQVPSRFSGSGSGTEFTLTISSLQPEDFATYYCQLLNSYPYTFGQGTKLEIK | 4578 | QLLNSYPYT | KAPPA |
| COV107_Plate2_HC_81-P1369 | 4579 | QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPYCSGGSCSDAFDIWGQGTMVTVSS | 4580 | AAPYCSGGSCSDAFDI | COV107_Plate2_kappa_81-P1389 | 4581 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 4582 | QQYGSSPWT | KAPPA |
| COV107_Plate2_HC_90-P1369 | 4583 | EVQLVQSGAEVKKPGESLKISCKGSGYSFTSYWIGWVRQMPGKGLEWMGIIYPGDSDTRYSPSFQGQVTISADKSISTAYMQWSSLKASDTAMYYCARSFRDDPRIAVAGPADAFDIWGQGTMVTVSS | 4584 | ARSFRDDPRIAVAGPADAFDI | COV107_Plate2_kappa_90-P1389 | 4585 | DIQMTQSPSTLSASVGDRVTITCRASQSISYWLAWYQQKPGKAPKLLIYQASSLESGVPSRFSGSESGTEFTLTISSLQPDDFATYYCQQYNSYPYTFGQGTKLEIK | 4586 | QQYNSYPYT | KAPPA |

TABLE 9-continued

Sequence pairs of antibody heavy and light chain variable regions from six individuals at 1.3 and 6.2 month time points.

| | | | | | | | | | |
|---|---|---|---|---|---|---|---|---|---|
| COV107_Plate2_HC_93-P1369 | 4587 | EVQLVESGGGLIQPGGSLRLSCAASGFIVSSNYMSWVRQAPGKGLEWVSVIYSGGSTFYTDSVKGRFTISRDNSKNTLYLQMNSLRAEDTAVYYCVRDYGDFYFDYWGQGTLVTVSS | 4588 | VRDYGDFYFDY | COV107_Plate2_kappa_93-P1389 | 4589 | EIVLTQSPGTLSLSPGERATLSCRASQSVSSSYLAWYQQKPGQAPRLLIYGASSRATGIPDRFSGGGSETDFTLTISRLEPEDCAVYYCQQYGSSPRTFGQGTKVEIK | 4590 | QQYGSSPRT | KAPPA |
| COV107_Plate2_HC_95-P1369 | 4591 | EVQLVESGGGLIQPGGSLRLSCAASGFTVSYNYMSWVRQAPGKGLEWVSIIYSGGSTYYADSVKGRFTISRDNSKNTLYLQMNSLRAEDTAIYYCARDYGDLYFDYWGQGTLVTVSS | 4592 | ARDYGDLYFDY | COV107_Plate2_kappa_95-P1389 | 4593 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTRLEIK | 4594 | QQYGSSPRT | KAPPA |
| COV107_Plate2_HC_9-P1369 | 4595 | EVQLVESGGGLVQPGGSLKLSCAASGFTFSGSAMHWVRQASGKGLEWVGRIRSKANSYATTYAASVKGRFTISRDDSKNTAYLQMNSLK1EDTAVYYCTKPHAHCGGDCYSRDWFDPWGQGTLVTVSS | 4596 | TKPHAHCGGDCYSRDWFDP | COV107_Plate2_kappa_9-P1389 | 4597 | DIQMTQSPSSLSASVGDRVTITCRASQSISSYLYWYQQKPGKAPKLLIYAASSLQSGVPSRFSGSGSGTDFTLTISSLQPEDFATYYCQQSYSTPPFTFGPGTKVDIK | 4598 | QQS | KAPPA |

TABLE 10

| Representative CDR sequences (based on the IMGT methodology)[a] | | | | | | | | | | | | |
|---|---|---|---|---|---|---|---|---|---|---|---|---|
| | HCDR1 | SEQ ID NO | HCDR2 | SEQ ID NO | HCDR3 | SEQ ID NO | LCDR1 | SEQ ID NO | LCDR2 | SEQ ID NO | LCDR3 | SEQ ID NO |
| C032 | GYSFTSYW | 4600 | IYPGDSDT | 4601 | ARGVAVDWYFDL | 4602 | SSNIGAGYD | 4603 | GNS | 4604 | QSYDSSLSALYV | 4605 |
| C051 | GFGVRNNY | 4606 | IYSGGTT | 4607 | AREGDVEGFSDLWSGYSRDRYYFDY | 4608 | SSDVGGYNY | 4609 | DVT | 4610 | SSFTSSNTRV | 4611 |
| C055 | GFSVSTKY | 4612 | LYSGRTD | 4613 | ARDSSEVRDHPGHPGRSVGAFDI | 4614 | SNDVGSYTL | 4615 | EDS | 4616 | CSYAGSHTFV | 4617 |
| C080 | GYSFTIYW | 4618 | IYPGDSDT | 4619 | ARGVAVDWYFDL | 4620 | SSNIGAGFD | 4621 | GNN | 4622 | QSSGSVLSDLYV | 4623 |
| C132 | GGSISSNNW | 4624 | IYHSGST | 4625 | ARGGDTAMGPEYFDY | 4626 | SSDVGGYNY | 4627 | DVS | 4628 | SSYTSSSTLL | 4629 |
| C143 | GFSVSTKY | 4630 | LYSGGSD | 4631 | ARDSSEVRDHPGHPGRSVGAFDI | 4632 | SNDVGSYTL | 4633 | EGT | 4634 | CSYAGASTFV | 4635 |
| C144 | GFTVSNNY | 4636 | IYSGGST | 4637 | AREGEVEGYNDFWSGYSRDRYYFDY | 4638 | SSDVGGYNY | 4639 | DVS | 4640 | SSYTSSSTRV | 4641 |
| C164 | GFSVSTKY | 4642 | LYSGGSD | 4643 | ARDSSEVRDHPGHPGRSVGAFDI | 4644 | SNDVGSYTL | 4645 | EVT | 4646 | CSYAGASTFV | 4647 |
| C512 | AGSISSNNW | 4648 | VYHNGNI | 4649 | AKGGDRAMGPEYFDS | 4650 | SSDVGANNY | 4651 | DVN | 4652 | SSFASSSTLL | 4653 |
| C548 | GGTFSSYA | 4654 | IIPIFGTA | 4655 | ARREAYGPRDYYYYGMDV | 4656 | SGYSN | 4657 | VGTGGIVG | 4658 | GADQGSGSNFVGV | 4659 |
| C549 | GGTFSTSA | 4660 | IIPFFGTP | 4661 | ARREPYGPRDYYYFFGMDV | 4662 | SDYSYYK | 4663 | VGPGGIVG | 4664 | GADEGSGGTFVGV | 4665 |

[a]CDR sequences were generated based on the IMGT methodology (https://www.ncbi.nlm.nih.goy/igblast/igblast.cgi).

SEQUENCE LISTING (4665 sequences)

SEQ ID NO: 1 - protein, 131 aa, Artificial Sequence
  Description of Artificial Sequence: Synthetic polypeptide
EVQLVESGGGLFQPGGSLRLSCAASGFSVRNNYVSWVRQAPGKGLEWVSVIYSGGTTYYADSVKGRFTISRDISENTLYLQMNSLRAEDTAVYYCAREGDVEGLHDFWSGYSRDRYYFDYWGQGTLVTVSS

SEQ ID NO: 2 - protein, 110 aa, Artificial Sequence
  Description of Artificial Sequence: Synthetic polypeptide
QSALTQPASVSGSPGQSIIISCTGTSGDIGGYNYVSWYQQHPGKAPKLMIYDVSFRPSGVSNRFSGSKSDNTASLTISGLQAEDEADYYCSSFTGNNTRVFGTGTKVTVL

SEQ ID NO: 3 - protein, 131 aa, Artificial Sequence
  Description of Artificial Sequence: Synthetic polypeptide
EVQLVESGGGLIQAGGSLRLSCAASGFGVRNNYMSWVRQAPGKGLEWVSVIYSGGTTYYADSVKGRFTISRDNSKNTVFLQMNSLRAEDTAVYYCAREGDVEGFSDLWSGYSRDRYYFDYWGQGTLVTVSS

SEQ ID NO: 4 - protein, 110 aa, Artificial Sequence
  Description of Artificial Sequence: Synthetic polypeptide
QSALTQPASVSGSPGQSITFSCTGTSSDVGGYNYVSWYQQYPGKAPKLLIYDVTNRPSGVSDRFSGSKSGNTASLTISGLQAEDEADYYCSSFTSSNTRVFGTGTKVTVL

SEQ ID NO: 5 - protein, 131 aa, Artificial Sequence
  Description of Artificial Sequence: Synthetic polypeptide
EVQLVESGGGLIRPGGSLRLSCAASGFSVSNNYMSWVRQAPGKGLEWVSVIYSGGTTYYADSVKGRFNISRDNSKNTVYLQMNSLRAEDTAVYYCAREGDVEGYYDFWSGYSRDRYYFDYWGQGALVTVSS

SEQ ID NO: 6 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCNSYTSNNTRVFGTGTKVTVL

SEQ ID NO: 7 - protein, 131 aa, Artificial Sequence
  Description of Artificial Sequence: Synthetic polypeptide
EVQLVESGGGLIQPGGSLRLSCAASGFIVSNNYMSWVRQAPGKGLDWVSVIYSGGTTYYADSVKGRFTISRDNSKNTLYLQMNSLRAEDTAVYYCAREGDVEGYHDSWSGYSRDRYYFDYWGQGTLVTVSS

SEQ ID NO: 8 - protein, 110 aa, Artificial Sequence
  Description of Artificial Sequence: Synthetic polypeptide
QSALTQPASVSGSPGQSITISCTGSSSDVGGYNFVSWYQQHPGRAPKLMIYDVSNRPSGVSNRFSGSKSGNTASLTISGLQVEDEADYYCSSYTNNNTRVFGTGTKVTVL

SEQ ID NO: 9 - protein, 131 aa, Artificial Sequence
  Description of Artificial Sequence: Synthetic polypeptide
EVQLVESGGGLIQPGGSLRLSCAASGFTVSNNYMSWVRQAPGKGLEWVSVIYSGGSTYDADSVKGRFTISRDNSKNTLYLQMNSLSAEDTAVYYCAREGDVEGYYDFWSGYSRDRYYFDYWGQGTLVTVSS

SEQ ID NO: 10 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSARVFGTGTKVTVL

SEQ ID NO: 11 - protein, 129 aa, Artificial Sequence
  Description of Artificial Sequence: Synthetic polypeptide
EVQLVESGGGLVQPGGSLRLSCAASGFSVSTKYMTWVRQAPGKGLEWVSVLYSGRTDYYADSVKGRFTISRDSSKNILYLQMSSLRVEDTGFYYCARDSSEVRDHPGHPGRSVGAFDIWSQGTMVTVSS

SEQ ID NO: 12 - protein, 110 aa, Artificial Sequence
  Description of Artificial Sequence: Synthetic polypeptide
QSALTQPASVSGSPGQSIAISCTGTSNDVGSYTLVSWYQQYPGKAPKLLIFEDSQRSSGISNRFSGSKSGNTASLTISGLRGEDEADYYCCSYAGSHTFVFGGGTKVTVL

SEQ ID NO: 13 - protein, 130 aa, Artificial Sequence
  Description of Artificial Sequence: Synthetic polypeptide
QVQLVQSGAEVKRPGASVKLSCKASGYIFTDYSIHWVRQAPGQGLEWMGWVNPNSGGGNSAQKFMDWVTMARDTSITTVYMELSRLRSDDTAVYYCARGPLFHKLVYDSWSGYHDGFDIWGQGTMVTVSS

SEQ ID NO: 14 - protein, 110 aa, Artificial Sequence
  Description of Artificial Sequence: Synthetic polypeptide
QSALTQPASVSGSPGQSITISCTGTSSDVGAYKFVSWYQQHPGKAPQLIIYEVSNRPSGVSNRFSGSKSGNTASLTISGLQAEDEADYYCSSYTNASTWVFGGGTELTVL

SEQ ID NO: 15 - protein, 130 aa, Artificial Sequence
  Description of Artificial Sequence: Synthetic polypeptide
QVQLVQSGAEVKKPGASVKVSCKASGYIFTDYSMHWVRQAPGQGLEWIGWVNPNSGGTNYAQKFQGWVTMARDTSITTVYMELSRLKSDDTAVYFCARGPLFHRLVYDFWSGYHDGFDMWGQGTMVTVSS

SEQ ID NO: 16 - protein, 110 aa, Artificial Sequence
  Description of Artificial Sequence: Synthetic polypeptide
QSALTQPASVSGSPGQSITISCTGTSSDVGGYKFVSWYQQHPGKAPKLMIYEVSNRPSGVSNRFSGSKSGNTASLTISGLQAEDEADYYCNSYTSSSTWVFGGGTKLTVL

SEQ ID NO: 17 - protein, 130 aa, Artificial Sequence
  Description of Artificial Sequence: Synthetic polypeptide
QVQLVQSGAEVKKPGASIKVSCKASGYTFTDYSMHWVRQAPGQGLEWMGWINPNSGGTKYAQKFQGWVTMTRDMSITTVYMELTRLRSDATAVFYCARGPLFHKLVYDSWTGYHDGFDIWGQGTMVTVSS

SEQ ID NO: 18 - protein, 110 aa, Artificial Sequence
  Description of Artificial Sequence: Synthetic polypeptide
QSALTQPASVSGSPGQSITISCTGTSSDVGGYNYVSWYQHYPGKAPKLMIYEVTHRPSGVSNRFSGSKSGNTASLTISGLQAEDEADYYCSSSTNSSTWVFGGGTKMTVL

SEQ ID NO: 19 - protein, 115 aa, Artificial Sequence
  Description of Artificial Sequence: Synthetic polypeptide
EVQLVESGGGLVQPGGSQRLSCAASGFTVSSNYMSWIRQAPGKGLEWVSVIYSGGSAYYVDSVKGRFTISRDNSKNTLYLQMNSLRPEDTAVYYCARIANYMDVWGKGTTVTVSS

SEQ ID NO: 20 - protein, 108 aa, Artificial Sequence
  Description of Artificial Sequence: Synthetic polypeptide
EIVMTQSPATLSVSPGERATLSCRASQSVSSHLAWYQQKPGQAPRLLIYGASTRATGIPTRFSGSGSGTEFTLTISSLQSEDFAVYYCQQYNNWPPLTFGGGTKVEIK

SEQ ID NO: 21 - protein, 122 aa, Artificial Sequence
  Description of Artificial Sequence: Synthetic polypeptide
EVQLVESGGGLVKPGGSLRLTCAASGFTFSTYSMNWVRQAPGKGLEWVSSISSSSSYIYYADSVKGRFTISRDNAKNSLYLQMNSLRAEDTAVYYCARERGYYGGKTPPFLGGQGTLVTVSS

SEQ ID NO: 22 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNYWVFGGGTKLTVL

SEQ ID NO: 23 - protein, 118 aa, Artificial Sequence
  Description of Artificial Sequence: Synthetic polypeptide
EVQLVQSGAEVKKPGDSLKISCKASGYSFTRYWIGWVRQMPGKGLDWMGIIYPGDSDTRYSSSFQGQVTISADKSISTAYLQWSSLKASDTSLYYCVRRASSTNFEFWGQGTLVTVSS

SEQ ID NO: 24 - protein, 108 aa, Artificial Sequence
  Description of Artificial Sequence: Synthetic polypeptide
SYELTQPPSVSVAPGQTATITCGGNNIGSKTVHWYQQKPGQAPVVVVYDDSDRPSGIPERFSGSKSGSTATLTITRVEAGDEADYYCQVWDSTSDHYVFGTGTKVAVI

SEQ ID NO: 25 - protein, 130 aa, Artificial Sequence
  Description of Artificial Sequence: Synthetic polypeptide
EVQLLESGGDLVQPGGSLRLSCAASGFTFSNYAMSWVRQAPGKGLEWVSAISGSGGNTYYADSVKGRFTISRDNSKNTLYLQMNSLRAEDTAVYYCAKAVHYGGNSDRRFSEPSAPFDYWGQGTLVTVSS

SEQ ID NO: 26 - protein, 111 aa, Artificial Sequence
  Description of Artificial Sequence: Synthetic polypeptide
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTPYVFGTGTKVTVL

SEQ ID NO: 27 - protein, 125 aa, Artificial Sequence
  Description of Artificial Sequence: Synthetic polypeptide
QVQLQESGPGLVKPSQTLSLTCTVSGGSISSSNYYWSWIRQHPGKGLEWIGYIDYSGGTYYNPSLKSRVTISVDTSKNQFSLKLSSVTAADTAVYYCARVSTTVTTYLVGGFDIWGQGTMVTVSS

SEQ ID NO: 28 - protein, 106 aa, Artificial Sequence
  Description of Artificial Sequence: Synthetic polypeptide
IRMTQSPSSLSASVGDRVTITCQASQDITNYLNWYQQKPGKAPKLLLYDASNLETGVPSRFSGSGSGTDFTFTISSLQPEDIATYYCQQYDNLPWTFGQGTKVEIK

SEQ ID NO: 29 - protein, 118 aa, Artificial Sequence
  Description of Artificial Sequence: Synthetic polypeptide
EVQLVESGGGLIQPGGSLRLSCAASGLLVSRNYMTWVRQAPGKGLEWVSVIYSGGSTFYADSVRGRFTISRDNSKNTLYLQMDSLRAEDTAVYYCARDVGDYYGMDVWGQGTTVTVSS

SEQ ID NO: 30 - protein, 108 aa, Artificial Sequence
  Description of Artificial Sequence: Synthetic polypeptide
DIQLTQSPAFLSASVGDRVTITCRASQGMSNYLAWYQQKPGKAPNLLIYTASTLQSGVPSRFSGSGSGTEFTLTISSLQPEDFATYYCQLLNSYPQLTFGGGTKVEIK

SEQ ID NO: 31 - protein, 129 aa, Artificial Sequence
  Description of Artificial Sequence: Synthetic polypeptide
VQLVESGGGVVQPGRSLRLSCAASGFSFRIFGMNWVRQAPGKGLDWVAGISHDGSDKYFADSVKGRFTISRDNSKNTLYLQMNSLRADDTAVYYCARDMEVDYYDRSGHYHVFHAFDIWGQGTMVTVSS

SEQ ID NO: 32 - protein, 113 aa, Artificial Sequence
  Description of Artificial Sequence: Synthetic polypeptide
DIVMTQSPDSLAVSLGARATINCKSSQSILYSSDNKSSLAWYQQKPGHPPKLLIYWASTRESGVPDRFSGSESGTDFTLTISNLQGEDVAVYYCQQYYSIPRSFGQGTKLEIK

SEQ ID NO: 33 - protein, 124 aa, Artificial Sequence
  Description of Artificial Sequence: Synthetic polypeptide
QVQLVESGGGVVQPGRSLRLSCVASGFSFSTYGMHWVRQAPGKGLEWVALIWSDGSNKYYGDAAEGRFTISRDNSNNTLYLQMNNLRAEDTALYYCARDHSSSSFVYYYYMDVWGKGTTVTVSS

SEQ ID NO: 34 - protein, 110 aa, Artificial Sequence
  Description of Artificial Sequence: Synthetic polypeptide
QSALTQPRSVSGSPGQSVTISCTGTSSDIGGYNYVSWYQQHPDKAPKFIIFDVSKRPSGVPDRFSGSKSGNTASLTISGLQAEDEADYYCCSYAGPYPYVFGTGTKVTVL

SEQ ID NO: 35 - protein, 118 aa, Artificial Sequence
  Description of Artificial Sequence: Synthetic polypeptide
QVQLVQSGAEVKKPGSSVNVSCKASGGTFSTYAIHWVRQAPGQGLEWMGGIIPLFHTANYAQKFQGRVTITADESTSTAYMELSSLRSEDTAMYYCAINTQWDLVPRWGRGTLVTVSS

SEQ ID NO: 36 - protein, 108 aa, Artificial Sequence
  Description of Artificial Sequence: Synthetic polypeptide
EIVLTQSPGTLSLAPGERATLSCRASQSVNSNYLAWYQQKPGQAPRLLIYGASSRATGIPDRFSGSGSGTDFTLTISRLEPEDFAVYYCQQYGFSLYSFGQGTKLEIK

SEQ ID NO: 37 - protein, 122 aa, Artificial Sequence
  Description of Artificial Sequence: Synthetic polypeptide
EVQLVESGGGLVKPGGSLRLSCAASGFTFSSAWMSWVRQAPGKGLEWVGRIKTKTDGGTKDYAAPVKGRFTISRDDSKNTLYLQMNSLKTEDTAVYYCTTTNDYGDYSPAYWGQGTLVTVSS

SEQ ID NO: 38 - protein, 107 aa, Artificial Sequence
  Description of Artificial Sequence: Synthetic polypeptide
DIQLTQSPSSLSASVGDRVTITCRASQSISSYLNWYQQKPGKAPKLLIYAASSLQSGVPSRFSGSGSGTAFTLTISSLQPEDFATYYCQQSYSTPLTFGGGTKVEIK

SEQ ID NO: 39 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISSSTSYIYYADSVKGRFTISRDNAKNSLYLQMNSLRAEDTAVYYCARERYGDNWGQGTLVTVSS

SEQ ID NO: 40 - protein, 109 aa, Artificial Sequence
  Description of Artificial Sequence: Synthetic polypeptide
QLVLTQSPSASASLGASVKLTCTLSSGHSSYAIAWHQQQPEKGPRYLMSLNSDGSHSKGDGIPDRFSGSSSGAERYLTISSLQSEDEADYYCQTWGPWVFGGGTKLTVL

SEQ ID NO: 41 - protein, 121 aa, Artificial Sequence
  Description of Artificial Sequence: Synthetic polypeptide
QVQLQESGPGLVKPSETLSLTCTVSGDSMSSYFWTWIRQPPGKGLECIGYFYPSGSTNYNPSLKSRVTISIDTSKNQFSLKLSSVTAADTAVYYCARLKQQLVGFGWFDPWGQGTLVTVSS

SEQ ID NO: 42 - protein, 110 aa, Artificial Sequence
  Description of Artificial Sequence: Synthetic polypeptide
QSVLTQPPSVSGAPGQRVTISCTGSSSNIGADYDVHWYQQFPGTAPKVLIYANTNRPSGVPERFSGSKSGTSASLAITGLQAEDEADYYCQSYDHSLNWVFGGGTKLTVL

SEQ ID NO: 43 - protein, 121 aa, Artificial Sequence
  Description of Artificial Sequence: Synthetic polypeptide
QVQLQESGPGLVKPSETLSLTCTVSGDSISTYFWAWIRQPPGRGLECIGSFFPSGSTYYNPSLKSRVTISVDTSKNQFSLKLNSVTAADTAVYYCARLKQQLVGFGWFDPWGQGSLVTVSS

SEQ ID NO: 44 - protein, 110 aa, Artificial Sequence
  Description of Artificial Sequence: Synthetic polypeptide
QSVLTQPPSVSGAPGQRVTISCTGSISNIGADYEVHWYVQFPGTAPKVLIYANTNRPSGVPERFSASKSGTSASLAITGLQAEDEADYYCQSYDHRLHWVFGGGTKLTVL

SEQ ID NO: 45 - protein, 125 aa, Artificial Sequence
  Description of Artificial Sequence: Synthetic polypeptide
QVQLVQSGAEAKKPGASVKVSCKTSGYTFTNYFMHWVRQAPGQGPEWMGIIDSSDGGASYAQKFQGRVTMTRDTSTSTVYMELRSLKFEDTAVYYCARASTSTTSWSDALSLGSWGQGTLVTVSS

SEQ ID NO: 46 - protein, 113 aa, Artificial Sequence
  Description of Artificial Sequence: Synthetic polypeptide
QSVLTQPPSVSGAPGQRVTISCTGSSSNIGGGSVVHWYQQLPGTAPKLLIYANSNRPSGVPDRFSGSKSGTSASLAIAGLQAEDEADYYCQSWDNGLSASGVVFGGGTKLTVL

SEQ ID NO: 47 - protein, 130 aa, Artificial Sequence
  Description of Artificial Sequence: Synthetic polypeptide
QVQLVESGGGVVQPGRSLRLSCAASGFTFRTYAMHWVRQAPGKGLEWVAVILSDGNNKYYADSVKGRFTISRDNSKNTLYLQMNSLRAEDTAIFYCAREQEANYYDISGYYHWGESLGYWGQGTLVTVSS

SEQ ID NO: 48 - protein, 109 aa, Artificial Sequence
  Description of Artificial Sequence: Synthetic polypeptide
DIQLTQSPSFLSASVGDRVTITCRASQGISSYLAWYQQKPGKAPKLLIYGASTLQSGVPSRFSGSGSGTEFTLTISSLQPEDFASYYCQKVNSHPPGLTFGGGTKVEIK

SEQ ID NO: 49 - protein, 130 aa, Artificial Sequence; identical to SEQ ID NO: 47
  Description of Artificial Sequence: Synthetic polypeptide

SEQ ID NO: 50 - protein, 109 aa, Artificial Sequence
  Description of Artificial Sequence: Synthetic polypeptide
DIQLTQSPSFLSASVGDRVTITCRASQGISSYLAWYQQKPGKAPKFLIYGASTLQSGVPSRFSGSGSGTEFTLTISSLQPEDFASYYCQKVNSYPPGLTFGGGTKVEIK

SEQ ID NO: 51 - protein, 117 aa, Artificial Sequence
  Description of Artificial Sequence: Synthetic polypeptide
EVQLVESGGGLIQPGGSLRLSCAASGITVSSNYMSWVRQAPGKGLEWVSVMYAGGSSFYADSVKGRFTISRDNSKNTLYLQMNSLRVEDTAVYYCARDLIALGVDVWGQGTTVTVSS

SEQ ID NO: 52 - protein, 108 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQLLNSYPMCSFGQGTKLEIK

SEQ ID NO: 53 - protein, 121 aa, Artificial Sequence
  Description of Artificial Sequence: Synthetic polypeptide
QVQLQESGPGLVKPSETLSLTCAVSGGSISSYYWSWIRQPPGKGLEWIGYIDTSGSTNYNPSLKSRVTMSVDTSKNQFSLNVNSVTAADTAVYFCGVCAGDCYAASVFDYRGQGTLVTVSS

SEQ ID NO: 54 - protein, 107 aa, Artificial Sequence
  Description of Artificial Sequence: Synthetic polypeptide
DIQMTQSPSSLSASVGDRVTITCQASQDIIFYLNWYQQKPGKAPKLLIYDASNLKTGVPSRFSGSGSGTDFAFTISSLQPEDIATYYCQQYDNLPLTFGGGTKVEIK

SEQ ID NO: 55 - protein, 123 aa, Artificial Sequence
  Description of Artificial Sequence: Synthetic polypeptide
QVQLVQSGPEVKKPGTSVKVSCKASGFTFGSSAVQWVRQARGQRLEWIGWIVVGSGNTDYAQRFQERVTITRDMSTNTVYMELSSLRFEDTAVYYCAAVYCSGTTCHDAFDIWGRGTMVTVSS

SEQ ID NO: 56 - protein, 114 aa, Artificial Sequence
  Description of Artificial Sequence: Synthetic polypeptide
DIQMTQSPCSLSASVGDRVTITCQATQDIRKYLNWFRRKLEKAPKLLIYDASTLDTRVPSRFSGNRSATDFTFTICSLQPEDNARYSCQQSDTLPPLGGDTPDTFGHGTKLEIK

SEQ ID NO: 57 - protein, 121 aa, Artificial Sequence
  Description of Artificial Sequence: Synthetic polypeptide
QVQLVQSGAEVKKPGSSVKVSCKASGDTFSSHAINWVRQAPGQGLEWMGRSIPMLGVTTSAQKFKGRVTITADHSTSTVFMDLSSLRSDDTAIYYCARGVVGATPGSFDLWGQGTMVTVSS

SEQ ID NO: 58 - protein, 106 aa, Artificial Sequence
  Description of Artificial Sequence: Synthetic polypeptide
EIVMTQSPATLSVSPGKRATLSCRASQSVRSNLAWYQQRPGQAPRLLIYDAATRATGIPTRFSGSGSGTEFTLTISSLQSEDFAVYYCQQYDNGLTFGGGTKVEIK

SEQ ID NO: 59 - protein, 117 aa, Artificial Sequence
  Description of Artificial Sequence: Synthetic polypeptide
QVQLQESGPGLVQPSGTLSLSCTVTGGSISSNNWWSWVRQSPVKGLEWIGEIYHNGNINYNPSLKSRVTMSIDKSKNHFSLKLSSVTAADTAVYYCARGDVLDWFDPWGQGTLVTVS

SEQ ID NO: 60 - protein, 110 aa, Artificial Sequence
  Description of Artificial Sequence: Synthetic polypeptide
QSALTQPASVSGSPGQSITFSCTGTSSDVGAYNYISWYQQHPGKAPKLMIYDVNNRPSGVSRRFSGSKSGNTASLTISGLQSEDEADYFCSSYAGNSTVRFGGGTKLTVL

SEQ ID NO: 61 - protein, 120 aa, Artificial Sequence
  Description of Artificial Sequence: Synthetic polypeptide
QVQLQESGPGLVKPSETLSLTCTVSGGSISSSYWNWIRQSPGKGLEWIGYIYYDGYTTFNPSLKSRVTISVDTSKNQFSLKLSSVTAADTAFYYCAAGLKGRSSSWYEYWGQGTLVTVSS

SEQ ID NO: 62 - protein, 107 aa, Artificial Sequence
  Description of Artificial Sequence: Synthetic polypeptide
DIQMTQSPSSLSASVGDRVTITCRASQSISSYLNWYQQKPGKAPKLLIYATSSLQSGVPSRFSGSGSGTDFTLTITSLQPEDFATYYCQQTYSSPHTFGQGTKLEIK

SEQ ID NO: 63 - protein, 128 aa, Artificial Sequence
  Description of Artificial Sequence: Synthetic polypeptide
EVQLLESGGGLVQPGGSLRLSCADSGFSFSTYGMSWVRQAPGKGLEWVSTISGSGDNTYHADSVKGRFTISRDNSKNTLYLQMNSLRAEDTAVYYCAKNIAEMSTFDDYFYYYGMDVWGQGTTVTVSS

SEQ ID NO: 64 - protein, 107 aa, Artificial Sequence
  Description of Artificial Sequence: Synthetic polypeptide
SYELTQPPSVSVSPGQTASITCSGDKLGDKYACWYQQKPGQSPVMVIYQDTKRPSGIPERFSGSNSGNTATLTISGTQAMDEADYYCQAWDSSTFYVFGTGTKVTVL

SEQ ID NO: 65 - protein, 122 aa, Artificial Sequence
  Description of Artificial Sequence: Synthetic polypeptide
EVQLVESGGGLVQPGGSLRLSCAASGFTFSSYDMHWVRQGTGKGLEWVSVIGTAGDAYYPGSVKGRFTISRENAKNSLYLQMNSLRAGDTAVYYCARMVYDSSGFKGYFDLWGRGTLVTVSS

SEQ ID NO: 66 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISNLQPEDFATYYCQQSYSTSMYTFGQGTKLEIK

SEQ ID NO: 67 - protein, 124 aa, Artificial Sequence
  Description of Artificial Sequence: Synthetic polypeptide
EVQLVESGGGVVQPGRSLRLSCAASGFTFSSYAIHWVRQAPGKGLEWVAVISFDGSNKYYRDSVKGRFTISRDNGKNTLYLQMNSLRAEDTAVYYCAKAALGYCTNGVCYCDNWGQGTLVTVSS

SEQ ID NO: 68 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLSISGLKTEDEADYYCQSYDINSLWVFGGGTRLTVL

SEQ ID NO: 69 - protein, 123 aa, Artificial Sequence
  Description of Artificial Sequence: Synthetic polypeptide
QLQLQESGPGLVKPSETLSLTCTVSGASIRNSNYFWGWIRQPPGKGLQWIGSIYYSGSTSYNPSLRTRVTVSVDTSKNQFSLKLSSVTAADTAVYYCARPRAGGDSSFFWDSWGRGTLVTVSS

SEQ ID NO: 70 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTMVFGGGTKLTVL

SEQ ID NO: 71 - protein, 122 aa, Artificial Sequence
  Description of Artificial Sequence: Synthetic polypeptide
QVQLQESGPGLVKPSGTLSLTCAVSGGSISSSNWWSWVRQPPGKGLEWIGEIYNSGSTNYNPSLKSRVTILVDKSKNQFSLKLSSVTAADTAVYYCAGSYSNYIGGVWFDPWGQGTLVTVSS

SEQ ID NO: 72 - protein, 106 aa, Artificial Sequence
  Description of Artificial Sequence: Synthetic polypeptide
EIVLTQSPATLSLSPGERATLSCRASQSVSTYLAWYQQKPGQAPRLLIYDASNRATGIPARFSGSGSGTDFTLTISSLEPEDFAVYYCQQRNNWLTFGGGTKVEIK

SEQ ID NO: 73 - protein, 124 aa, Artificial Sequence
  Description of Artificial Sequence: Synthetic polypeptide
QVQLQQWGAGLLKPSETLSRTCAVYGGSFSGYYWSWFRQSPGKGLEWIGEINHSGSTNYNPSLKNRVTISVDTSKNQFSLMLSSVTAADTAVYYCARGGFGVVINYYYSGMDVWGRGTTVTVSS

SEQ ID NO: 74 - protein, 112 aa, Artificial Sequence
  Description of Artificial Sequence: Synthetic polypeptide
DIVMTQSPLSLPVTPGEPASISCRSSQSLLHSNGYNYLDWYLQKSGQSPQLLIYLGSNRASGVPDRFSGSGSGTDFTLKISRVEAEDVGVYYCMQALQTPPTFGQGTKVEIK

SEQ ID NO: 75 - protein, 234 aa, Artificial Sequence
  Description of Artificial Sequence: Synthetic polypeptide
EVQLVESGGGLVQPGGSLRLSCAATEITVSSNYMTWVRQAPGKGLEWVSVIYPGGSTFYADSVKGRFSISRDNSKNTLYLQMNSLRAEDTAVYYCARDLVVYGLDCWGQGTLVTVSSEVQLVESGGGLVQPGGSLRLSCAATEITVSSNYMTWVRQAPGKGLEWVSVIYPGGSTFYADSVKGRFSISRDNSKNTLYLQMNSLRAEDTAVYYCARDLVVYGLDCWGQGTLVTVSS

SEQ ID NO: 76 - protein, 107 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNTYPPPFGGGTKVEIK

SEQ ID NO: 77 - protein, 122 aa, Artificial Sequence
  Description of Artificial Sequence: Synthetic polypeptide
QVQLQESGPGLVKPSGTLSLTCAVSAGSISSNNWWSWVRQPPGKGLEWIGEVYHNGNINYNPSLKSRVTLSVDKSKNQFSLKLSSVTAADTAVYYCAKGGDRAMGPEYFDSWGQGTLVTVSS

SEQ ID NO: 78 - protein, 110 aa, Artificial Sequence
  Description of Artificial Sequence: Synthetic polypeptide
QSALTQPASVSGSPGQSITISCTGTSSDVGANNYVSWYQQHPGKAPKLMIYDVNERPSGVSNRFSGSKSGNTASLTISGLQTEDEADYYCSSFASSSTLLFGGGTKLTVL

SEQ ID NO: 79 - protein, 125 aa, Artificial Sequence
  Description of Artificial Sequence: Synthetic polypeptide
EVQLLESGGGLVQPGGSLRLSCVASGFSFSTYAMSWVRQAPGQGLEWVSTITGTSIGTYYADSVKGRFTISRDNSKNTVFLQMKSLRAEDAAVYYCANHPLASGDEYYYYYMDVWGKGTTVTVSS

SEQ ID NO: 80 - protein, 109 aa, Artificial Sequence
  Description of Artificial Sequence: Synthetic polypeptide
EIVLTQSPDTLSLSPGERATLSCRASQSVHSKQLAWYQQKPGQAPRLLIYGASSRATGIPDRFSGSGSGTDFTLTISRLEPEDFAVYYCQQYGSIRALTFGGGTKVEIK

SEQ ID NO: 81 - protein, 116 aa, Artificial Sequence
  Description of Artificial Sequence: Synthetic polypeptide
EVQLVESGGGLVQPGGSLRLSCAASEFIVTRNYMSWVRQAPGKGLEWVSLIYPGGSTFYADSVKGRFTISRDNSKNTLFLHMNSLRAEDTAVYYCARDLAGRLDYWGQGTLVTVSS

SEQ ID NO: 82 - protein, 108 aa, Artificial Sequence
  Description of Artificial Sequence: Synthetic polypeptide
DIQMTQSPSSLSASVGDRVTITCQASQDINNFLNWYQQKPGKAPKLLIYDASNLETGVPSRFSGSGSGTDFTFTISSLQPEDIAIYYCQQYDSLSRLTFGGGTKVEIK

SEQ ID NO: 83 - protein, 117 aa, Artificial Sequence
  Description of Artificial Sequence: Synthetic polypeptide
EVQLVESGGGLVQPGGSLRLSCAASGFIVSSNYMSWVRQAPGKGLEWVSILYSGGSTYYADSVKGRFTISRDNSKNTLYLQMNSLRAEDTAVYYCARDLVVYGADYWGQGTLVTVSS

SEQ ID NO: 84 - protein, 107 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPPFGGGTKVEIK

SEQ ID NO: 85 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGRIIPMLVIATYARKFQGRVTITADKSTSTAYMELSSLRSEDTAVYYCARGVVAATPGNFDIWGQGTMVTVSS

SEQ ID NO: 86 - protein, 106 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNGLTFGGGTKVEIK

SEQ ID NO: 87 - protein, 116 aa, Artificial Sequence
  Description of Artificial Sequence: Synthetic polypeptide
EVQLVESGGGLVQPGGSLRLSCAASEFIVSRNYMSWVRQAPGKGLEWVSLIYSGGSTYYADSVKGRFTISRDNSKNTLYLQMNSLRAEDTAMYYCARDIAGRLDYWGQGTLVTVSS

SEQ ID NO: 88 - protein, 108 aa, Artificial Sequence
  Description of Artificial Sequence: Synthetic polypeptide
DIQMTQSPSSLSASVGDRVTITCQASQDISKYLNWYQQKPGKAPKLLIYDASNLETGVPSRFSGSGSGTDFTFTISSLQPEDFATYYCQHYDSLSRLTFGGGTKVEIK

SEQ ID NO: 89 - protein, 123 aa, Artificial Sequence
  Description of Artificial Sequence: Synthetic polypeptide
QVQLVQSGPEVKKPGTSVKVSCKASGFTFTNSAVQWVRQSRRQRLEWIGWIVVGSGNTNYAQKFQERVTITRDMSTSTAYMELSSLRSEDTAVYYCAAVDCNSTSCYDAFDIWGQGTMVTVSS

SEQ ID NO: 90 - protein, 108 aa, Artificial Sequence
  Description of Artificial Sequence: Synthetic polypeptide
EIVLTQSPGTLSLSPGERATLSCRASQSFRSSYLAWYQQKPGQAPRLLIYGASSRATGIPDRFSGSGSGSDFTLTISRLEPEDFAVYYCQQYDISPWTFGQGTKVEIK

SEQ ID NO: 91 - protein, 123 aa, Artificial Sequence
  Description of Artificial Sequence: Synthetic polypeptide
QVQLVQSGPEVKKPGTSVKVSCKASGFTFSSSAVQWVRQARGQRLEWIGWIVVGSGNTNYAQKFQERVTITRDMSTSTAYMELSSLRSEDTAVFYCAAPYCNVTTCFDGFNIWGRGTMVTVSS

SEQ ID NO: 92 - protein, 108 aa, Artificial Sequence
  Description of Artificial Sequence: Synthetic polypeptide
EIVLTQSPGTLSLSPGERATLSCRASQSVRSSYFAWYQQKPGQAPRLLIYAASSRATGIPDRFSGSGSGTDFTLTISRLEPEDFALYYCQQYGSSPWTFGQGTKVEIK

SEQ ID NO: 93 - protein, 123 aa, Artificial Sequence
  Description of Artificial Sequence: Synthetic polypeptide
QVQLQESGPGLVKPSETLSLTCTVSGASISSHYWSWIRQPPGKGLEWIGYIHYIGSTNYNPSLKSRVTILLDTSKNQFSLRLRSVTAADTAVYYCARGWPYCGVDCYSGFDYWGQGTLVTVSS

SEQ ID NO: 94 - protein, 111 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGLWVFGGGTKLTVL

SEQ ID NO: 95 - protein, 122 aa, Artificial Sequence
  Description of Artificial Sequence: Synthetic polypeptide
EVQLVESGGDLIQPGGSLRLSCAASGFSVSNSYMSWVRQAPGKGLEWVSIIYSGGSTYYADSVKGRFTISRDNSKNTLYLQMNSLRAEDTAVYFCAKTPRGDYDSSGTSAYWGQGTLVTVSS

SEQ ID NO: 96 - protein, 112 aa, Artificial Sequence
  Description of Artificial Sequence: Synthetic polypeptide
QLVLTQSPSASASLGASVNLTCTLSSGHSSYAIAWHQQQPEKGPRFLMKLSSDGSHNKGDGIPDRFSGSSSGAERFLTISSLQSEDEADYYCQTWGIGSDWVFGGGTKLTVL

SEQ ID NO: 97 - protein, 121 aa, Artificial Sequence
  Description of Artificial Sequence: Synthetic polypeptide
EVQLVESGGRLVQPGRSLRLSCAASGFTFDDYAIHWVRQAPGKGLEWVSGISWNSGSIGYADSVRGRFTISRDNAKNSLYLQMNSLRAEDTALYYCAKGLDSSSSASPDYWGQGTLVTVSS

SEQ ID NO: 98 - protein, 107 aa, Artificial Sequence
  Description of Artificial Sequence: Synthetic polypeptide
DIQMTQSPSSVSASVGDRVTITCRASQDISSWLAWYQQKPGKAPKLLIYLASSLQSGVPSRFSGSGSGTDFILTISSLQPEDFGTYYCQQGNSFPLTFGGGTKVEIK

SEQ ID NO: 99 - protein, 126 aa, Artificial Sequence
  Description of Artificial Sequence: Synthetic polypeptide
QVQLVQSGAEVKKPGASVKVSCKASGHTFTTYYLHWVRQAPGQGLEWMGRIDPSGGSTTYAQKFQGRVTMTRDTSTSTVYMELSSLRSEDTALYYCARGGYCGSTSCSPDDYFDYWGQGTLVTVSS

SEQ ID NO: 100 - protein, 109 aa, Artificial Sequence
  Description of Artificial Sequence: Synthetic polypeptide
SYELTQPPSVSVAPGKTARITCGGNNIGSKSVHWYQQKPGQAPVLVIYYDSDRPSGIPERFSGSNSGNTATLTISRVEAGDEADYYCQVWDSSSDHYYVFGTGTKVTVL

SEQ ID NO: 101 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVALIGYDGTDKYYAENVKGRFTISRDNSKNTLFLQMNSLRGGDTAVYLCARDGIPFRYGMDVWGQGTTVTVSS

SEQ ID NO: 102 - protein, 107 aa, Artificial Sequence
  Description of Artificial Sequence: Synthetic polypeptide
DIQMTQSPSTLSASVGDRVTITCRASQSIDIWLAWYQQKPGKAPKFLIHKASTLESGVPSRFSGSGSGTEFTLTISSLQPDDFATYYCQHYHSYSGTFGQGTKVEIK

SEQ ID NO: 103 - protein, 122 aa, Artificial Sequence
  Description of Artificial Sequence: Synthetic polypeptide
EVQLVESGGGLVQPGGSLRLSCAASGFTFRNYDMHWVRQVAGKGLEWVSAIGTSGDTYYPDSVKGRFTISRENAKNSVYLQMNNLRAGDTAVYFCVRDREISGWTGWYFDLWGRGTLVTVSS

SEQ ID NO: 104 - protein, 108 aa, Artificial Sequence
  Description of Artificial Sequence: Synthetic polypeptide
DIQMTQSPSSLSASVGDRVTITCRASQTIHNYLNWYQQIPGKAPRLLIYATNTLQSGVPSRFSGSGSGTDFTLTITGLQPEDFATYYCQQSYSTPPITFGQGTRLEIK

SEQ ID NO: 105 - protein, 127 aa, Artificial Sequence
  Description of Artificial Sequence: Synthetic polypeptide
EVQLLESGGGLVQPGGSLRLSCAASGFTFNNYAMNWVRQAPGRGLEWVSGISGSGANTYYADSVKGRFTISRDNPKNTLSLQMNSLRAEDTALYYCAKVLSPTYYDSWSGPDAFDFWGQGTMVTVSS

SEQ ID NO: 106 - protein, 108 aa, Artificial Sequence
  Description of Artificial Sequence: Synthetic polypeptide
DIQMTQSPSTLSASVGDRVTITCRASQTISPWLAWYQQKPGKAPNLLIYKASSLESGVPSRFSGSGSGTEFTLTISSLQPDDFATYYCQQYNSYSSWTFGQGTKVEIK

SEQ ID NO: 107 - protein, 129 aa, Artificial Sequence
  Description of Artificial Sequence: Synthetic polypeptide
QVQLVESGGGVAQPGRSLRLSCAASGFTFSRYGMHWVRQAPGKGLEWVAVIWHDGSDKYCADFVKGRFTISRDNSKNTLYMQMDSLRAEDTAVYYCARGGRPDHETGIAVLGEYYFDSWGQGTLVTVSS

SEQ ID NO: 108 - protein, 106 aa, Artificial Sequence
  Description of Artificial Sequence: Synthetic polypeptide
SYELTQPPSVSVSPGQTARITCSGDAFPLQYGYWYQQKPGQAPVLVIYKDKERPSGISERFSGSSSGTTVTLTISGVQAEDEADYYCQSADTNGVVFGGGTSLTVL

SEQ ID NO: 109 - protein, 130 aa, Artificial Sequence
  Description of Artificial Sequence: Synthetic polypeptide
EVQLVESGGGLVQPGRSLRLSCVATGFTFDDFAMHWVRQAPGKGLEWVSGISWNGGIIGYVDSVKGRFTISRDNAKNSLYLQMNSLRPEDTALYYCVKGYRYYYDILTGYYNDAGAFDYWGQGTLVTVSS

SEQ ID NO: 110 - protein, 107 aa, Artificial Sequence
  Description of Artificial Sequence: Synthetic polypeptide
DIQSTQSPSFLSASVGDRVAITCRASQGISSYLAWYQQKPGKAPKLLIYPASTLQSGVPSGFSGSGSGTEFTLTISSLQPEDFATYYCQQLNDYPFTFGPGTKVDIK

SEQ ID NO: 111 - protein, 120 aa, Artificial Sequence
  Description of Artificial Sequence: Synthetic polypeptide
EVQLVQSGAEVKKPGESLKISCKGSGYRFTNYWIGWVRQMPGKGLEWIGNIFPGDSDSRYSPSFQGQVTISVDMSITTAYLHWSSLKASDTAIYYCARLSERWYSPFDSWGQGTLVTVSS

SEQ ID NO: 112 - protein, 110 aa, Artificial Sequence
  Description of Artificial Sequence: Synthetic polypeptide
EIVMTQSPATLSVSPGERATLSCRASQSVSSNLAWYQQKPGQAPRLLIYGASTRATGFPARFSGSGSGTEFTLTISSLQSEDFAVYFCQQYNNWPPGGFTFGPGTKVDIK

SEQ ID NO: 113 - protein, 130 aa, Artificial Sequence
  Description of Artificial Sequence: Synthetic polypeptide
EVQLVESGGSLVKPGGSLRLSCVASGLTFNHAWMSWVRQAPGKGLEWVGRIKSKIDGGTTDYAAPVKGRFTISRDDSKSTQYLQMNSLKTEDTAVYYCTTDCFWRLGGTTCYEHDAFDVWGQGTMVTVSS

SEQ ID NO: 114 - protein, 106 aa, Artificial Sequence
  Description of Artificial Sequence: Synthetic polypeptide
DIQMTQSPSSLSASVGDRVTITCRASQAIATFLNWYQQKPGKAPKLLIYAASSLQSGVPSRFSGSGSGTDFTLTISNLQPEDFATYYCQQSYNSLHFGGGTKVEIK

SEQ ID NO: 115 - protein, 131 aa, Artificial Sequence
  Description of Artificial Sequence: Synthetic polypeptide
QVQLVQSGAEVKKPGSSVRVSCKASGGTFSRNVISWVRQAPGQGLEWMGGIIPMFATANYAQKFQGRVTITADESSSTAYMELSSLRSEDTAVYYCAREDFILVSAPIRENSYYYYGMDVWGQGTTVTVSS

SEQ ID NO: 116 - protein, 108 aa, Artificial Sequence
  Description of Artificial Sequence: Synthetic polypeptide
EIVLTQSPGTLSLSPGERATLSCRASQSVSSNYLAWYQQKPGQAPRLLIYDASSRATGIPDRFSGSGSGTDFTLTISRLEPEDFAVYYCQQYGGSPRTFGQGTKVEIK

SEQ ID NO: 117 - protein, 121 aa, Artificial Sequence
  Description of Artificial Sequence: Synthetic polypeptide
EVQLVESGGALVQPGRSLRLSCAASGFTFDDYAMHWVRQAPGKGLEWVSSISWNGVSIGYADSVRGRFTISRDNAKNSLYLQMNSLKIGDTAFYYCARGLDGSSSASPDSWGQGTLVTVSS

SEQ ID NO: 118 - protein, 107 aa, Artificial Sequence
  Description of Artificial Sequence: Synthetic polypeptide
DIQMTQSPSSVSASVGDRVTITCRASQGIGSWLAWYQQKPGKAPKLLIYLASSLQSGVPSRFSGSGSGTYFTLTISGLQPEDFATYYCQQGNSFPLTFGGGTKVEIK

SEQ ID NO: 119 - protein, 129 aa, Artificial Sequence
  Description of Artificial Sequence: Synthetic polypeptide
QVQLVESGGGLVKPGRSLRLSCTVSGFTFGAYAMSWFRQAPGKGLEWVGFIRSKTYGGTTEYAASLKGRFTISRDDSKSIAFLQMNSLKTEDTAVYFCSRGGYYDGSPYYWNRPDAFDIWGLGTMVTVS

SEQ ID NO: 120 - protein, 112 aa, Artificial Sequence
  Description of Artificial Sequence: Synthetic polypeptide
QSVLTQPPSASGTPGQRITISCSGSSSNIGSNTVNWYQQLPGTAPKLLIYSNNQRPSGVPDRFSGSKSGTSASLAISGVQSEDEADYYCAAWDDSLNGPDVVFGGGTKLTVL

SEQ ID NO: 121 - protein, 124 aa, Artificial Sequence
  Description of Artificial Sequence: Synthetic polypeptide
QLQLQESGPGLVKPSETLSLTCTVSGGAISSRNYHWGWIRQPPGKGLEWIGSIYYSGSTYYSPSLKSRVTISVDTSKNQFSLRLSSVTAADTAVYYCARLETSGWYTEDVFDIWGQGTMVTVSS

SEQ ID NO: 122 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLLPEDFATYYCQRSYSAMYTFGQGTKLEIK

SEQ ID NO: 123 - protein, 122 aa, Artificial Sequence
  Description of Artificial Sequence: Synthetic polypeptide
QLQLQESGPGLVKPSETLSLTCTVSGGSISSSSYYWAWIRQPPGKGLEWIGNIYYSGITYYSPSLKSRVTISVDTSKNQFSLKLRSVTAADTAVYYCARQHRYGSGSSELLWGQGTLVTVSS

SEQ ID NO: 124 - protein, 110 aa, Artificial Sequence
  Description of Artificial Sequence: Synthetic polypeptide
QSALTQPPSASGSPGQSVTISCTGTSSDVGSYNYVSWYQQHPGKAPKLMIYEVTKRPSGVPDRFSGSKSGNTASLTVSGLQADDEADYYCSSYAGSSNLIFGGGTKLTVL

SEQ ID NO: 125 - protein, 121 aa, Artificial Sequence
  Description of Artificial Sequence: Synthetic polypeptide
EVQLVESGGGLVQPGRSLRLSCAASGFTFDDYALHWVRQAPGKGLEWVSGISWNGDSIGYADSVKGRFTISRDNAKNSLSLQMNSLTAEDTALYYCAKGVEYSSSSNCDYWGQGTLVTVSS

SEQ ID NO: 126 - protein, 106 aa, Artificial Sequence
  Description of Artificial Sequence: Synthetic polypeptide
DIQMTQSPSSVSASVGDRVTITCRASQDISSWLAWYQQKPGKAPKLLISLASGLQSGVPSRFSGSGSETDFTLTISSLQPEDFATYYCQQTNSFPLTFGGGTKVEI

SEQ ID NO: 127 - protein, 122 aa, Artificial Sequence; identical to SEQ ID NO: 103
  Description of Artificial Sequence: Synthetic polypeptide

SEQ ID NO: 128 - protein, 108 aa, Artificial Sequence; identical to SEQ ID NO: 104
  Description of Artificial Sequence: Synthetic polypeptide

SEQ ID NO: 129 - protein, 117 aa, Artificial Sequence
  Description of Artificial Sequence: Synthetic polypeptide
EVQLVESGGGLVQPGGSLRLSCAASGLTVTSNYMSWVRQAPGRGLEWVSLIYPGGTTYYADSVKGRFTVSRDNSKNTLYLQMDSLRAEDTGVYYCARETLGRGGDCWGQGTLVTVSS

SEQ ID NO: 130 - protein, 107 aa, Artificial Sequence
  Description of Artificial Sequence: Synthetic polypeptide
DIQMTQSPSSLSASVGDRVTITCQASQDISNFLNWYQQKPGKAPKLLIYDASNLETGVPSRFSGSRSGTDFTFTISSLQPDDIATYYCQQYDNLPRSFGQGTKLEIK

SEQ ID NO: 131 - protein, 128 aa, Artificial Sequence
  Description of Artificial Sequence: Synthetic polypeptide
QVQLVESGGGVVQPGRSLRLSCTASGFTFSTAGMHWVRQAPGKGLEWVAVISYDGSNKDYADSVKGRFTISRDNSKSTLYLQMNSLRPEDTAVYYCAKDTPGGDDIMTGWGLYGMDVWGQGTTVTVSS

SEQ ID NO: 132 - protein, 107 aa, Artificial Sequence
  Description of Artificial Sequence: Synthetic polypeptide
DIQMTQSPSSLSASVGDRVTITCRASQSISSYLNWYHQKPGKAPKLLIYAAISLQSGVPSRFSGSGFGTDFTLTISSLQPEDFAIYYCQQSYSTPWTFGQGTKVEIK

SEQ ID NO: 133 - protein, 119 aa, Artificial Sequence
  Description of Artificial Sequence: Synthetic polypeptide
QVQLVQSGAEVKKPGASVKVSCKASGYTFSSHDINWVRQATGQGLEWVGWMNPNSGNTGSAQSFQGRVTLTRNASISTAYLELSSLRSEDTAVYFCARGFSLTWYFDLWGRGTLVTVSS

SEQ ID NO: 134 - protein, 110 aa, Artificial Sequence
  Description of Artificial Sequence: Synthetic polypeptide
SYELTQPPSVSAAPGKTARITCGGNNIGGKNVHWYQQKPGQAPVLVVFDDSDRPSGIPERFSGSNSGNTATLTISRVEAGDEADYYCQLWDSTSDHPDVVFGGGTQLTVL

SEQ ID NO: 135 - protein, 120 aa, Artificial Sequence
  Description of Artificial Sequence: Synthetic polypeptide
EVQLLESGGGLVKPGGSLRLSCAASGFTFSDYSMTWVRQAPGKGLEWVSFISSSSTYIYYADSVKGRFTISRDNAKSSLYLQMNRLRAEDTAVYYCTRVQVGARGWADYWGQGTLVTVSS

SEQ ID NO: 136 - protein, 110 aa, Artificial Sequence
  Description of Artificial Sequence: Synthetic polypeptide
NFMLTQPLSVSESPGKTVTISCTRSSGSIASNYVQWYQQRPGGAPTTVIYEDTQRPSGVPDRFSGSIDSSSNSASLTISGLKTEDEADYYCQSCDTINWVFGGGTKLTVV

SEQ ID NO: 137 - protein, 125 aa, Artificial Sequence
  Description of Artificial Sequence: Synthetic polypeptide
EVQLLESGGGLVHPGGSLRLSCAASGFTFSTYAMHWVRQAPGKGLEWVSAISGSGTGTFYADSVKGRFSISRDNSKNTLYLQMNSLRAEDTAVYYCATERIAVSDTRMYNWFDPWGQGTLVTVSS

SEQ ID NO: 138 - protein, 108 aa, Artificial Sequence
  Description of Artificial Sequence: Synthetic polypeptide
DIQMTQSPSSLSASVGDRVTLTCRASQGISTYLNWYQQKPGKAPNLLIYAASSLQSGVPSRFSGSGSGTDFTLTISSLQPEDFATYYCQQSYSAPPWTFGQGTKVEIK

SEQ ID NO: 139 - protein, 128 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDTPGGDDILTGWGLYGMDVWGQGTTVTVSS

SEQ ID NO: 140 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAAFSLQSGVPSRFSGSGSGTDFTLTISSLQPEDFATYYCQQSYSTPWTFGQGTKVEIK

SEQ ID NO: 141 - protein, 126 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARREAYGPRDYYYYYGMDVWGQGTTVTVSS

SEQ ID NO: 142 - protein, 116 aa, Artificial Sequence
  Description of Artificial Sequence: Synthetic polypeptide
QSALTQPPSASASLGASVTLTCTLSSGYSNYKVDWYQQRPGKGPRFVMRVGTGGIVGSKGDGIPDRFSVLGSGLNRYLTIKNIQEEDESDYHCGADQGSGSNFVGVFGGGTKLTVL

SEQ ID NO: 143 - protein, 126 aa, Artificial Sequence
  Description of Artificial Sequence: Synthetic polypeptide
QVQLVQSGAEVKKPGSSVKVSCKASGGTFSTSAISWVRQAPGQGLEWMGGIIPFFGTPNYAQKFQGRVTIIADESTTTAYMELSGLRFEDSAVYYCARREPYGPRDYYYFFGMDVWGPGTTVTVSS

SEQ ID NO: 144 - protein, 115 aa, Artificial Sequence
  Description of Artificial Sequence: Synthetic polypeptide
QSALTQPPFASASLGASVTLTCTLSSDYSYYKVDWYQQRPGKGPRFVIRVGPGGIVGSKGDGFPDRFSVLGSGLNRSLTINNIQEEDEGDYHCGADEGSGGTFVGVFGGGTKLTV

SEQ ID NO: 145 - protein, 120 aa, Artificial Sequence
  Description of Artificial Sequence: Synthetic polypeptide
EVQLVQSGAEVKKPGESLKISCKGSGYRFTNYWIGWVRQMPGKGLEWMGIIYPGDSDTRYSPSFQGQVTISADKSITTAYLQWSSLKASDTAMYYCARLSDRWYSPFDPWGQGTLVTVSS

SEQ ID NO: 146 - protein, 110 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPPGGFTFGPGTKVDIK

SEQ ID NO: 147 - protein, 120 aa, Artificial Sequence
  Description of Artificial Sequence: Synthetic polypeptide
QVQLVESGGGVVQPGRSLRLSCAASGFTFSSYAMHWVRQAPGKGLEWVALISYDGSNKHYADSVKGRFTISRDNSKNTLYLQMNSLRAEDTAVYYCARAGTTNSDYFDYWGQGTLVTVSS

SEQ ID NO: 148 - protein, 108 aa, Artificial Sequence
  Description of Artificial Sequence: Synthetic polypeptide
SYELTQPPSVSVAPGKTARITCGGNNIGSKSVHWYQQKPGQAPVLVIYYDTDRPSGIPERFSGSNSGNTATLTISRVEAGDEADYYCQVWDSSSALWVFGGGTKLTVL

SEQ ID NO: 149 - protein, 120 aa, Artificial Sequence
  Description of Artificial Sequence: Synthetic polypeptide
QVQLVESGGGVVQPGRSLRLSCAASGFTFSNYEIHWVRQAPGKGLEWVAGISYDGSTKYYADSVKGRFTISRDNSKNTLYLQMNSLRPEDTAVFYCARAGTTNSDYFDYWGQGTLVTVSS

SEQ ID NO: 150 - protein, 108 aa, Artificial Sequence
  Description of Artificial Sequence: Synthetic polypeptide
SYELTQPPSVSVAPGMTARITCGGNTIGSKSVHWYQQKAGQAPVLVIYYDSDRPSGIPERFSGSNSGNTATLTISRVEAGDEADYYCQVWDSSSVLWVFGGGTKLTVL

SEQ ID NO: 151 - protein, 123 aa, Artificial Sequence
  Description of Artificial Sequence: Synthetic polypeptide
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDDPGSYYYGMDVWGQGTTVTVSS

SEQ ID NO: 152 - protein, 109 aa, Artificial Sequence
  Description of Artificial Sequence: Synthetic polypeptide
QTVVTQEPSLTVSPGGTVTLTCGSSTGAVTSGHYPYWFQQKPGQAPRTLIYDTSNKHSWTPARFSGSLLGGKAALTLSGAQPEDEAEYYCLLSYSGARVFGGGTKLTVL

SEQ ID NO: 153 - protein, 123 aa, Artificial Sequence
  Description of Artificial Sequence: Synthetic polypeptide
EVQLVESGGGLVKPGGSLRLSCAASGLTFSTTWMSWVRQAPGKGLEWVGRIKSKGDGGTTDFAGPVKGRFSISRDDSKNTLYLHMNSLKTEDTAVYYCTTDDPGSYYYGMDVWGQGTTVTVSS

SEQ ID NO: 154 - protein, 109 aa, Artificial Sequence
  Description of Artificial Sequence: Synthetic polypeptide
QTVVTQEPSLTVSPGGTVTLTCASSTGAVTSGHYPYWFQQKPGQAPRTLIYATSNKHSWTPARFSGSLLGGKAALTLSGAQPEDEADYYCLLSYSGARVFGGGTKLTVL

SEQ ID NO: 155 - protein, 124 aa, Artificial Sequence
  Description of Artificial Sequence: Synthetic polypeptide
QVQLVQSGAEVKKPGASVKVSCKASGYTFTYYYMHWVRQAPGQGLEWMGIINPSGGSTSYAQKFQGRVTMTRDTSTSTVYMELSSLRSEDTAVYYCARPLLPGETGSLNRLDYWGQGTLVTVSS

SEQ ID NO: 156 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTLWTFGQGTKVEIK

SEQ ID NO: 157 - protein, 124 aa, Artificial Sequence
  Description of Artificial Sequence: Synthetic polypeptide
QVQLVQSGAEVKKPGASVKVSCKASGYPFSRYYIHWVRQAPGQGLEWMGIINPSGGSTTYAQRFQGRVTMTRDTSASTVYLDLSSLGSEDSAVYYCARPLLPGETGNLNRLDYWGQGTLVTVSS

SEQ ID NO: 158 - protein, 107 aa, Artificial Sequence
  Description of Artificial Sequence: Synthetic polypeptide
  MOD_RES (45)..(45): Any amino acid
DIQMTQSPSSLSASVGDRVTITCRASQSISSYLNWYQQKPGIAPXLLIYGASSLQSGVPSRFSGSGSGTDFTLTISSVQPDDFATYYCQQSYSTLWTFGQGTKVEIK

SEQ ID NO: 159 - protein, 124 aa, Artificial Sequence
  Description of Artificial Sequence: Synthetic polypeptide
EVQLVQSGAEVKKPGESLKISCKVSGYTFTNYWIGWVRQMPGKGLEWMGIIYPGDSDTRYSPSFQGQVTISADKSIITAYLQWSSLKASDTAMYYCARVPSSSDYGDYGGFEYWGQGTLVTVSS

SEQ ID NO: 160 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPCSFGQGTKLEIK

SEQ ID NO: 161 - protein, 124 aa, Artificial Sequence
  Description of Artificial Sequence: Synthetic polypeptide
EVQLVQSGAEVKKPGESLKISCKVSGYTFTNYWIGWVRQMPGKGLEWMGIIFPGDSDTRYSPSFQGQVTISADRSITTAYLQWRSLKASDTAMYYCARVPSSSDYGDYGGFEYWGQGTLVTVSS

SEQ ID NO: 162 - protein, 107 aa, Artificial Sequence
  Description of Artificial Sequence: Synthetic polypeptide
DIQMTQSPSSLSASVGDRVTITCRASQTITIYLNWYQQKPGKAPKLLIYAASSLQSGVPSRFSGSGSGTDFTLTISSLQPEDFATYYCQQSYSTPCSFGQGTKLEIK

SEQ ID NO: 163 - protein, 130 aa, Artificial Sequence
  Description of Artificial Sequence: Synthetic polypeptide
EVQLVESGGGLVQPGRSLRLSCAASGFTFDDYAMHWVRQAPGKGLEWVSGVSWNSGTIGYADSVKGRFTISRDNAKNSLYLQMNSLRAEDTALYYCAKIADIVRAYDFWSGQHFDAFDIWGQGTMVTVSS

SEQ ID NO: 164 - protein, 108 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLVVFGGGTKLTVL

SEQ ID NO: 165 - protein, 130 aa, Artificial Sequence
  Description of Artificial Sequence: Synthetic polypeptide
EVQLVESGGGLVQPGRSLRLSCAASGFTFDDYAIHWVRQAPGKGLEWVSGVSWNSGTIGYADSVKGRFFISRDNAKNSLYLQMNSLRAEDTAWYYCAKIADLVGAYDFRSGQHFAAFDVWGQGTMVTVSS

SEQ ID NO: 166 - protein, 108 aa, Artificial Sequence
  Description of Artificial Sequence: Synthetic polypeptide
QSVLTQPPSASGTPGQRVTISCSGSSSNIGSNTVNWYQHLPGTAPKLLIYSNNQRPSGVPDRFSGSKSGTSASLAISGLQSEDEADYYCASWDDSLVVFGGGTKLTVL

SEQ ID NO: 167 - protein, 123 aa, Artificial Sequence
  Description of Artificial Sequence: Synthetic polypeptide
EVQLVESGGGVVQPGKSLRLSCAASGFTFRSYAMHWVRQAPGKGLEWVAVIWDDGSSKHYSDSVKGHFTISRDNSKNTLYLQMNSLRAEDTAVYYCARDSNVDTVMVTWFDYWGQGTMVTVSS

SEQ ID NO: 168 - protein, 108 aa, Artificial Sequence
  Description of Artificial Sequence: Synthetic polypeptide
DIQMTQSPSSLSASVGDRVTITCRASQSISNYLNWYQQKPGKAPNLLIYTASSLQSGVPSRFSGSGSGTDFTLTISSLQPEDFATYYCQQSYSTPPWTFGQGTKVEIK

SEQ ID NO: 169 - protein, 129 aa, Artificial Sequence
  Description of Artificial Sequence: Synthetic polypeptide
EVQLVESGGGLVKPGGSLRLSCAASGFPFTNAWMSWVRQAPGKGLEWVGHIKDYTDGGTTDYAAPVKGKFTISRDDSKNTLYLHMNSLKTEDTAVYYCSTVGSYYYDSRGPTSDAFDIWGQGTLVTVSS

SEQ ID NO: 170 - protein, 113 aa, Artificial Sequence
  Description of Artificial Sequence: Synthetic polypeptide
DIVMTQSPDSLAVSLGERATINCKSSQSVLYSSNKKNYLAWYRQKPGQPPKLLIYWASTRESGVPDRFSGSGSGTDFTLTISSLQAEDVAVYYCQQYYSTPYTFGQGTKLEIK

SEQ ID NO: 171 - protein, 125 aa, Artificial Sequence
  Description of Artificial Sequence: Synthetic polypeptide
EVQLLESGGGLVQPGTSLRLSCAASGFTFSSYAMSWVRQAPGKGLEWVSAISSSGGSTYYADSVKGRFTISRDNSKNTLYLHMNSLRAEDTAVYYCATERIAVAGTRMYNWFDPWGQGTLVTVSS

SEQ ID NO: 172 - protein, 108 aa, Artificial Sequence
  Description of Artificial Sequence: Synthetic polypeptide
DIQMTQSPSSLSASVGDRVTLTCRASQSISSYLNWYQQKPGKAPNLLIYAASSLQSGVPSRFSGSGSGTDFTLTISSLQPEDFATYYCQQSYSAPPWTFGQGTKVEIK

SEQ ID NO: 173 - protein, 120 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVQVGARGWVDYWGQGTLVTVSS

SEQ ID NO: 174 - protein, 110 aa, Artificial Sequence
  Description of Artificial Sequence: Synthetic polypeptide
NFMLTQPHSVSESPGKTVTISCTRSSGSIASNYVQWYQQRPGSAPTTVIYEDNERPSGVPDRFSGSIDSSSNSASLTISGLKTEDEADYYCQSYDRINWVFGGGTKLTVL

SEQ ID NO: 175 - protein, 120 aa, Artificial Sequence
  Description of Artificial Sequence: Synthetic polypeptide
EVQLVESGGGLVKPGGSLRLSCAASGFTFSSYSMNWVRQAPGKGLEWVSFISSRSSYIYYADSVKGRFTISRDNAKNSLYLQMNSLRAEDTAVYYCARVQVGARGWVDYWGQGTLVTVSS

SEQ ID NO: 176 - protein, 110 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSINWVFGGGTKLTVL

SEQ ID NO: 177 - protein, 119 aa, Artificial Sequence
  Description of Artificial Sequence: Synthetic polypeptide
VQLVESGGGVVQPGGSLRLSCVASGFEFRDYGMHWVRQAPGKGLHWVAIVQSDGKNIYYADSVKGRFTISRDNSKRSQYLQMNSLRPEDTAVYYCAKENYRGTGYLESWGQGTLVTVSS

SEQ ID NO: 178 - protein, 107 aa, Artificial Sequence
  Description of Artificial Sequence: Synthetic polypeptide
DIQMTQSPSTLAASVGDTVTITCRASYDVKKWVAWYQQKPGKVPKLLIYKASTLEVGVPLRFSGSGSGTEFTLTINGLQPDDFATYYCQHFHSYPYSFGQGTKLEIK

SEQ ID NO: 179 - protein, 123 aa, Artificial Sequence
  Description of Artificial Sequence: Synthetic polypeptide
QLQLQESGPGLVKPSETLSLTCTVSGASIPSSTSYWGWIRQPPGKGLEWIGSIYYTGSTYYNPSLKSRVTISVDTSKNHFSLILSSVTAADTAVYYCARRSITLAGRDCLDFWGQGTLVTVSS

SEQ ID NO: 180 - protein, 107 aa, Artificial Sequence
  Description of Artificial Sequence: Synthetic polypeptide
DIQLTQSPSSLSASVGDRLTITCRASQSITTSLNWYQQKPGKAPKLLIYAASSLQSGVPSRFSGSGSGTDFTLAISSLQPEDFATYYCQQSYIPLLTFGGGTKVDIK

SEQ ID NO: 181 - protein, 130 aa, Artificial Sequence
  Description of Artificial Sequence: Synthetic polypeptide
VQLLESGPGLLKPSQTLSLTCAISGDSVSSSGAAWNWIRQSPSRGLEWLGRTYYKSKWYNDYAVSVKSRITINPDTSKNQFSLQLNSVTPEDTAVYYCARMWVVAGTTDDYYYHYGMDVWGQGTTVTVSS

SEQ ID NO: 182 - protein, 106 aa, Artificial Sequence
  Description of Artificial Sequence: Synthetic polypeptide
IRMTQSPSSVSASVGDRVTITCRASQGISNWLAWYQQKPGKAPKVLLYAASSLRSGVPSRFSGSGSGTDFTLTISSLQPEDFATYYCQQTNTLPLSFGGGTKVDIK

SEQ ID NO: 183 - protein, 119 aa, Artificial Sequence
  Description of Artificial Sequence: Synthetic polypeptide
QVQLVQSGAEVKKPGASVKVSCKASGYTFTSYAMHWVRQAPGQRLEWMGWINTDNGNTKYSQKFQGRVTITRDTSASTAYMELSSLRSEDTAVYYCAREGALTNWFDPWGQGTLVTVSS

SEQ ID NO: 184 - protein, 109 aa, Artificial Sequence
  Description of Artificial Sequence: Synthetic polypeptide
SYELTQPPSVSVAPGQTARIPCGGNNIGSKSVHWYQQKPGQAPVLVVYDDSDRPSGIPERFSGSNSGNTATLTISRVEAGDEADYYCQVWDSSSDLHVVFGGGTKLTVL

SEQ ID NO: 185 - protein, 119 aa, Artificial Sequence
  Description of Artificial Sequence: Synthetic polypeptide
QVQLQQWGAGLLKPSETLSLTCAVYGGSLSAYYWSWIRQPPGKGLEWIGEINNGGTTNYNPSLKSRVTLSVDTSKNQFSLELSSVTAADTAIYYCARPGITATTGFDFWGQGSLVTVSS

SEQ ID NO: 186 - protein, 109 aa, Artificial Sequence; identical to SEQ ID NO: 184
  Description of Artificial Sequence: Synthetic polypeptide

SEQ ID NO: 187 - protein, 118 aa, Artificial Sequence
  Description of Artificial Sequence: Synthetic polypeptide
VQLVESGGGVVQPGGSLRLSCAASLFSFSDYGMHWVRQAPGKGLEWVAFIWYDGTKKDYTHSVKGRFTVSRDNSKNTLYLQMNSLRAEDTAMYYCAKARGFQHYFDQWGQGTLVTVSS

SEQ ID NO: 188 - protein, 112 aa, Artificial Sequence
  Description of Artificial Sequence: Synthetic polypeptide
QSALTQPASVSGSPGQSITISCTGTSSDVGSYNLVSWYQQHPGKAPKLLIYEVGKRPSGVSNRFSGSKSGNTASLTISGLQAEDEADYYCCSYAGSGTLGVVFGGGTKLTVL

SEQ ID NO: 189 - protein, 119 aa, Artificial Sequence
  Description of Artificial Sequence: Synthetic polypeptide
EVQLVQSGAEVKKPGESLNISCKASGYSFTIYWIAWVRQLPGKGLEWMGIIYPGDSDTRYSPSFQGQVTISADKSISTAYLQWRSLKASDSAVYYCARGVAVDWYFDLWGRGTLVTVSS

SEQ ID NO: 190 - protein, 112 aa, Artificial Sequence
  Description of Artificial Sequence: Synthetic polypeptide
QSVLTQPPSVSGAPGQRVTISCAGSSSNIGAGFDVYWYQQLPGTAPKLLIYGNNNRPSGVPDRFSGSKSGTSASLAITGLQAEDEADYYCQSSGSVLSDLYVFGTGTKVTVL

SEQ ID NO: 191 - protein, 124 aa, Artificial Sequence
  Description of Artificial Sequence: Synthetic polypeptide
QVQLVQSGAEVKKPGSSVKVSCKASGGTFSSYTISWVRQAPGQGLEWMGRIIPILGIANYAQKFQGRVTITADKSTSTAYMELSSLRSEDTAVYYCARDSGYSGYGSTYYMDVWGKGTTVTVSS

SEQ ID NO: 192 - protein, 111 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTVTKVTVL

SEQ ID NO: 193 - protein, 124 aa, Artificial Sequence
  Description of Artificial Sequence: Synthetic polypeptide
QVQLVQSGAEVKKPGSSVKVSCKASGGSFTNHFISWVRQAPGQGLEWMGRIIPILGTANYAQNFQGRVMMTADKSTSTAYMELSSLRSEDTAVYYCARDSGYSGYGSTYYMDVWGKGTTVTVSS

SEQ ID NO: 194 - protein, 111 aa, Artificial Sequence
  Description of Artificial Sequence: Synthetic polypeptide
QSVLTQPPSVSGAPGQRVTISCTGSNSNIGAGYDVHWYQQLPGAAPKLLIYGNNNRPSGVPDRFSGSKSDTSASLAITGLQVEDEADYYCQSYDSSLSDSVFGSGTKVTVL

SEQ ID NO: 195 - protein, 121 aa, Artificial Sequence
  Description of Artificial Sequence: Synthetic polypeptide
QVQLQESGPGLVKPSETLSLTCTVSGGSISSYYWSWIRQPPGKGLEWIGYIHYSGSTNYNPSLKSRVTISVDTSKNQFSLKLSSVTAADTAVYYCARHYDILTALSWFDPWGQGTLVTVSS

SEQ ID NO: 196 - protein, 111 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYWVFGGGTKLTVL

SEQ ID NO: 197 - protein, 122 aa, Artificial Sequence
  Description of Artificial Sequence: Synthetic polypeptide
QVQLQESGPGLVKPSETLSLTCNVSGVSISTDYWSWIRQPPGKGLEWIGYIYYSGNTKDYNPSLKSRVTISVDTSKNQFSLMLSSVTAADTAVYYCARHYDILTSLSWFDPWGQGTLVTVSS

SEQ ID NO: 198 - protein, 111 aa, Artificial Sequence
  Description of Artificial Sequence: Synthetic polypeptide
QSVLTQPPSVSAAPGQKVTISCSITNSNLGNIYVSWYQQLPGTAPKLLIYGNNKRPSGIPDRFSGSKSGTSATLGITGLQTGDEAHYYCGTWDSSLSANWVFGGGTKLTVL

SEQ ID NO: 199 - protein, 127 aa, Artificial Sequence
  Description of Artificial Sequence: Synthetic polypeptide
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARDSEYSSSWYSRGYYGMDVWGQGTTVTVSS

SEQ ID NO: 200 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPTFGGGTKVEIK

SEQ ID NO: 201 - protein, 121 aa, Artificial Sequence
  Description of Artificial Sequence: Synthetic polypeptide
EVQLVESGGGLVQPGGSLRLSCAASGFIFSSYWMTWVRQAPGKGLEWVASIKYNGNERNYVDSVKGRFTISRDNARNSLFLQLNNLGAEDTAVYYCARQPESTIWYYFDYWGQGTLVTVSS

SEQ ID NO: 202 - protein, 108 aa, Artificial Sequence
  Description of Artificial Sequence: Synthetic polypeptide
SYELTQPPSVSVSPGQTARVTCSGHALPDQYTYWYQQRPGRAPVLVIYVNNQRPSGIPDRFSATTSGTTVTLTISGVQAEDEADYYCQSADSSGSYVVFGGGTKLTVL

SEQ ID NO: 203 - protein, 125 aa, Artificial Sequence
  Description of Artificial Sequence: Synthetic polypeptide
QVQLQQWGAGLLKPSETLSLTCAVFGGSFSGYYWGWIRQPPGKGLEWIAEINHSENSHYNPSLKSRVTISVDTFKNQFSLNLSSVTAADTALYYCVRRPRRYCSGDTCRGAFDIWGQGTMVTVSS

SEQ ID NO: 204 - protein, 107 aa, Artificial Sequence
  Description of Artificial Sequence: Synthetic polypeptide
DIQMTQSPSSLSASVGDRVTITCRASQDISNFLAWYQQKPGKVPSLLIYAASILQPGVPSRFSGSGSGTDFTLTITSLQPEDVATYYCQKYKIDPFTFGPGTKVDIK

SEQ ID NO: 205 - protein, 116 aa, Artificial Sequence
  Description of Artificial Sequence: Synthetic polypeptide
EVQLVESGGGLVRPGGSLTLSCVASGFTVGSNFMSWVRQAPGKGLEWVSLIYNSGGTHYADSVKGRFTISRDRSKNTLYLQMNSLRAEDTAIYYCANHGYYYYMDVWGKGTTVTVS

SEQ ID NO: 206 - protein, 111 aa, Artificial Sequence
  Description of Artificial Sequence: Synthetic polypeptide
QSALTQPASVSGSPGQSITISCTGTGSDIGAYNYVSWHQHHPGKAPKLIIYDVSNRPSGVSNRFSGSKSGNTASLTISGLQAEDEADYYCTSYTNTTTPWVFGGGTKVTVL

SEQ ID NO: 207 - protein, 116 aa, Artificial Sequence
  Description of Artificial Sequence: Synthetic polypeptide
EVQLVESGGGLIQPGGSLRLSCAASEFIVSRNYMSWVRQAPGKGLEWVSVIYSGGSTFYADSVKGRFTISRDESKNTLYLQMNSLRAEDTAIYYCARDRGGGILDYWGQGTLVTVS

SEQ ID NO: 208 - protein, 108 aa, Artificial Sequence
  Description of Artificial Sequence: Synthetic polypeptide
DIQMTQSPSSLSASVGDRVTITCQASQDINIFLNWYQQKPGKAPKLLIYDASSLETGVPSRFSGSGSGTDFTFTISSLQPEDFATYYCQQYGNLPKYTFGQGTKLEIK

SEQ ID NO: 209 - protein, 123 aa, Artificial Sequence
  Description of Artificial Sequence: Synthetic polypeptide
VQLVEAGGGVVQPGRSLRLSCAASGLAFSIYGMHWVRQAPGKGLEWVAIVAQDGSKKYYADSVKGRFTISRDNSKNTLYLEMNSLRTEDTAVYYCVKEGRPSDTVVVVAFDYWGQGSLVTVSS

SEQ ID NO: 210 - protein, 107 aa, Artificial Sequence
  Description of Artificial Sequence: Synthetic polypeptide
DIQLTQSPSSLSASVGDRVTITCRASQSISNYLNWYQQKPGKAPKVIIYAASSLQSGVPSRFSGSGSGTDFTLTISSLQPEDFATYYCQQSHSIPRTFGQGTKVEIK

SEQ ID NO: 211 - protein, 126 aa, Artificial Sequence
  Description of Artificial Sequence: Synthetic polypeptide
EVQLVESGGGLVKPGGSLRLSCVASGFTFRNAWMNWVRQAPGKGLEWVGRIKANSDGGTIDYAEPVQGRFTISREDSRNSLYLQMNSLKTEDTAVYYCTTGPQYDDFGHSYIVDSWGPGTLVTVSS

SEQ ID NO: 212 - protein, 112 aa, Artificial Sequence
  Description of Artificial Sequence: Synthetic polypeptide
DIVMTQSPLSLPVTLGEPASISCRSSQSLLHSNGFHFLEWYLQKPGQSPQLLIYVGSNRASGVPDRFSGSGSGTDFTLKISRVEAEDVGVYYCMQTLQTPLTFGGGTKVEIK

SEQ ID NO: 213 - protein, 123 aa, Artificial Sequence
  Description of Artificial Sequence: Synthetic polypeptide
QVQLQESGPGLVKPSQTLSLTCTVSGGSISSGPYYWSWIRQHPGKGLEWIGYIYYSGSTYYNPSLKSRVTISVDTSKKQFSLNLNSVTAADTAVYYCARVWQYYDSTGSFDYWGQGTLVTVSS

SEQ ID NO: 214 - protein, 112 aa, Artificial Sequence
  Description of Artificial Sequence: Synthetic polypeptide
DIVMTQSPLSLPVTPGEPASISCRSSRGLLHSNGYNYLDWYLQKPGQSPQLLIYLGSNRASGVPDRFSGSGSVTDFTLNISRVEAEDVGVYYCMQALQTPFTFGPGTKVDIK

SEQ ID NO: 215 - protein, 118 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDLYSSGGTDIWGQGTMVTVSS

SEQ ID NO: 216 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPGTFGQGTKVEIK

SEQ ID NO: 217 - protein, 118 aa, Artificial Sequence
  Description of Artificial Sequence: Synthetic polypeptide
EVQLVESGGGLIQPGGSLRLSCAASGITVSSNYMSWVRQAPGKGLEWVSVMYAGGSTFYADSVKGRFTISRDDSKNTLFLQMNSLRAEDTAIYYCARDLYSSGGTDIWGQGTMVTVSS

SEQ ID NO: 218 - protein, 108 aa, Artificial Sequence
  Description of Artificial Sequence: Synthetic polypeptide
EIVLTQSPGTLSLSPGERATLSCRASQSIGSSYLAWYQQKPGLAPRLLIYGASRRATGIPDKFSGSGSGADFTLTISRLEPEDFAVYYCQQYGSSPGTFGQGTKVEIK

SEQ ID NO: 219 - protein, 121 aa, Artificial Sequence
  Description of Artificial Sequence: Synthetic polypeptide
QLVQSGPEVKKPGTSVKVSCKASGFTFYNSAVQWVRQARGQRLEWVGWIVVGSGNTDYAQKFQERVTMTRDLSTNTAYMEVNSLRSEDTAVYYCAAPYCSGGTCLDGFDIWGQGTMVTVSS

SEQ ID NO: 220 - protein, 108 aa, Artificial Sequence
  Description of Artificial Sequence: Synthetic polypeptide
EIVLTQSPGTLSLSPGERGTLSCRASQSVRSNYLAWYKQRPGQAPRLLVYGASSRATGIPDRFSGSGSGTDFTLTISRLEPEDFAVYYCQQYGSSPWTFGQGTKVEIK

SEQ ID NO: 221 - protein, 128 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAREAHDGALTDYGDYLNWFDPWGQGTLVTVSS

SEQ ID NO: 222 - protein, 110 aa, Artificial Sequence
  Description of Artificial Sequence: Synthetic polypeptide
SYELTQPPSVSVAPGKTARITCGGNNIGSKSVHWYQQKPGQAPVLVIYYDSDRPSGIPERFSGSNSGNTATLTISRVEAGDEADYYCQVWDSSSDHLYWVFGGGTKLTVL

SEQ ID NO: 223 - protein, 128 aa, Artificial Sequence
  Description of Artificial Sequence: Synthetic polypeptide
EVQLVESGGGLVQPGGSLRLSCAASGFTFSTYSMNWVRQAPGKGLEWVSYISSSSSTIHYADSVKGRFTISRDNAKNSLYLQMNSLRDEDTAVYYCAREAHDGALTDYGDYLNWFDPWGQGTLVTVSS

SEQ ID NO: 224 - protein, 110 aa, Artificial Sequence
  Description of Artificial Sequence: Synthetic polypeptide
SYELTQPPSVSVAPGKTARITCGGTNIGSKNVHWYQQKPGQAPVLVIYYDNDRPSGIPERFSGSNSGNTATLTISRVEAGDEADYYCQVWDTTSDHFYWVFGGGTKLTVL

SEQ ID NO: 225 - protein, 126 aa, Artificial Sequence
  Description of Artificial Sequence: Synthetic polypeptide
EVQLVESGGGLAQPGRSLRLSCAASGFTFDDYAMHWVRQAPGKGLEWVSGINWNSGSLGYADSVKGRFTISRGIAKNSLYLQMNSLRPEDTAFYYCAKAGVRGIAAAGPDLNFDYWGQGTLVTVSS

SEQ ID NO: 226 - protein, 103 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFIGSGSGTDFTLTISSLEPEDFAVYYCQQRITFGQGTRLEIK

SEQ ID NO: 227 - protein, 123 aa, Artificial Sequence
  Description of Artificial Sequence: Synthetic polypeptide
QVQLQESGPGLVKPSETLSLTCTVSGGSISSTTYYWDWIRQSPGKGLEWIGSIFYTGITYYSPSLKSRVTISVDTSKNQFSLRLNSMTAADTAVYYCARRLRQLWFGPWFDPWGQGTLVTVSS

SEQ ID NO: 228 - protein, 110 aa, Artificial Sequence
  Description of Artificial Sequence: Synthetic polypeptide
QSALTQPPSASGSPGQSVTISCTGTRSDVGDYNYVSWYQQHPDKAPKLIIYEVTKRPSGVPDRFSGSKSGNTASLTVSGLQAEDEADYYCSSYAGSNNVMFGGGTKLTVL

SEQ ID NO: 229 - protein, 127 aa, Artificial Sequence
  Description of Artificial Sequence: Synthetic polypeptide
VQLQESGPGLVKPSETLSLTCAVSGGSVSSGNYYWNWIRQPPGKGLEWIGYIYYSGSTNYNPSLKSRVTISVDTSKNQFSLKLNSVTAADTAVYHCARETYYYDSSGYYISDAFDIWGQGTMVTVSS

SEQ ID NO: 230 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSFSYTFGQGTKLEIK

SEQ ID NO: 231 - protein, 128 aa, Artificial Sequence
  Description of Artificial Sequence: Synthetic polypeptide
QVQLQESGPGLVKPSETLSLTCTVSGGSVSSGTFYWSWIRQPPGKGLEWIGYIHYSGSTNYNPSLKSRVTISVDTSKNQFSLRLSSVTAADTAVYYCARESFYYDRSGYYGSDAFDIWGQGTMVTVSS

SEQ ID NO: 232 - protein, 107 aa, Artificial Sequence
  Description of Artificial Sequence: Synthetic polypeptide
DIQMTQSPSTLSSSVGDRVTITCRASQNISRWLAWYQQKPGKAPKLLIYKASTLESGVPSRFSGSGSGTKFTLTISSLQPDDFATYYCQQYNSYLYTFGQGTKLEIK

SEQ ID NO: 233 - protein, 123 aa, Artificial Sequence
  Description of Artificial Sequence: Synthetic polypeptide
QVQLQESGPGLVKPSETLSLTCIVSGGSINSTTYYWDWIRQSPGKGLEWIGSIFYTGITYYSPSLKTRVTISVDTSKNQFSLRLNSMTAADTAVYYCARRLRQLWFGPWFDPWGQGTLVTVSS

SEQ ID NO: 234 - protein, 110 aa, Artificial Sequence
  Description of Artificial Sequence: Synthetic polypeptide
QSALTQPPSASGSPGQSVTISCTGTRSDVGDYNYVSWYQQHPDKAPKLIIFEVTKRPSGVPDRFSGSKSGNTASLTVSGLQAEDEADYYCSSYAGSSNVMFGGGTKLTVL

SEQ ID NO: 235 - protein, 123 aa, Artificial Sequence
  Description of Artificial Sequence: Synthetic polypeptide
EVQLLESGGGLVQPGGSLRLSCAGSGFTFSHYALSWVRQAPGKGLEWVSCISGTGGNSHYADSVKGRFTSSRDNSKNILYLQMNSLRAEDTAVYFCAKGGDFWSGYLIPFDSWGQGTLVTVSS

SEQ ID NO: 236 - protein, 108 aa, Artificial Sequence
  Description of Artificial Sequence: Synthetic polypeptide
SYELTQSPSVSVAPGKTARITCGGDSIGSKNVHWYQQKPGQAPVLVMYYDNDRPSGIPERFSGYNSGNTATLSISRVEAGDEADYYCLVWDGSGDPWVFGGGTKLTVL

SEQ ID NO: 237 - protein, 124 aa, Artificial Sequence
  Description of Artificial Sequence: Synthetic polypeptide
VQLVESGGGVVQPGRSLRLSCAASGFTFSRYGMHWVRQAPGKGLEWVAVSSYDGSNEYYANSVKGRFTISRDNSKNTLYLQMNSLRAEDTAVYYCAKTGASYCGGDCPFHFDYWGQGTLVTVSS

SEQ ID NO: 238 - protein, 106 aa, Artificial Sequence
  Description of Artificial Sequence: Synthetic polypeptide
IRMTQSPSSLSASVGDRVTITCQASQDINNYLNWYQQKPGKAPKLLIYDASDLETGVPSRFSGGGSGTDFTFTISSLQPEDIATYYCQHYNNLPITFGQGTRLEIK

SEQ ID NO: 239 - protein, 120 aa, Artificial Sequence
  Description of Artificial Sequence: Synthetic polypeptide
EVQLVESGGGLVKPGGSLRLSCAASGFTFSNVWMSWVRQAPGKGLEWVGRIKSKIDGGTTEYAAPVKGRFIISRDDSKNTLSLQMNSLKTEDTAVYYCTTDHGREPPVHWGQGTLVTVSS

SEQ ID NO: 240 - protein, 107 aa, Artificial Sequence
  Description of Artificial Sequence: Synthetic polypeptide
EIVLTQSPGTLSLSPGERASLSCRARQSVYSNYLAWYQHKSGQAPRLLFYGASSRATDIPDRFSASGSGTDFTLTISRLEPEDFAVYYCLQYGPSPTFGPGTRLEIK

SEQ ID NO: 241 - protein, 125 aa, Artificial Sequence
  Description of Artificial Sequence: Synthetic polypeptide
EVQLVESGGGLVKPGGSLRLSCAASGFTFSSYSMNWVRQAPGKGLAWVSSISSSNNIIYYADSVKGRFTISRDDAKDSLYLHMKSLRADDTAVYFCARVPSWAPYQLLPGPFDYWGQGILVTVSS

SEQ ID NO: 242 - protein, 106 aa, Artificial Sequence
  Description of Artificial Sequence: Synthetic polypeptide
IRMTQSPSSLSASVGDRVTITCQASQAIASYLSWYQHKPGRAPKLLIYDASNLEIGVPSRFSGSGSGTDFTFTISSLQSEDNATYYCQQYESLPGTFGGGTKVEIK

SEQ ID NO: 243 - protein, 126 aa, Artificial Sequence
  Description of Artificial Sequence: Synthetic polypeptide
EVQLVESGGGLVQPGGSLRLSCAASGFSFSTYWMSWVRQAPGKGLEWVADIKQDGSEKYFVDSVKGRFTISRDNAKNSLYLHLNSLRAEDTAVYYCAREMAGSGNYYWFGYGMDVWGQGTTVTVSS

SEQ ID NO: 244 - protein, 106 aa, Artificial Sequence
  Description of Artificial Sequence: Synthetic polypeptide
IRMTQSPSSVSASVGDRVTITCRASQGISSWLAWYQQKPGKAPKLLIYAASSLQSGVPSRFSGSESGTDFTLTISSLQPEDFATYYCQQANSFPLTFGGGTKVEIK

SEQ ID NO: 245 - protein, 124 aa, Artificial Sequence
  Description of Artificial Sequence: Synthetic polypeptide
QVQLVQSGAEVRKPGASVKVSCMASGYTFNTYDINWVRQGTGQGLEWMGWMNPNSGNTGHAQKFQGRVAMTVNTSMNTAYMELSSLRSEDTAVYYCARGADMLNVAVGADFDYWGQGTLVTVSS

SEQ ID NO: 246 - protein, 110 aa, Artificial Sequence
  Description of Artificial Sequence: Synthetic polypeptide
QSALTQPPSASGSPGQSVTISCTGTSSDVGGYNFVSWFQQHPGKAPKLMIYEVSKRPSGVPDRFSGSKSANTASLTVSGLQAEDEADYFCSSYAGSNNWVFGGGTKLTVL

SEQ ID NO: 247 - protein, 118 aa, Artificial Sequence
  Description of Artificial Sequence: Synthetic polypeptide
EVQLVESGGGLIQPGGSLRLSCAASGLIVSSNYMNWVRQAPGKGLEWVSLLYSGGSTYYADSVKGRFTISRDNSKNTLYLQMNSLRPEDTAVYYCARDLSVVGAFDIWGQGTMVTVSS

SEQ ID NO: 248 - protein, 109 aa, Artificial Sequence
  Description of Artificial Sequence: Synthetic polypeptide
EIVLTQSPGTLSLSPGERATLSCRASQSLPSTYLAWYQQKRGQAPRLLIYGASSRATGIPDRFSGSGSGTDFTLTISRLEPEDFAVYYCQQYGTSPRVTFGPGTKVDIK

SEQ ID NO: 249 - protein, 121 aa, Artificial Sequence
  Description of Artificial Sequence: Synthetic polypeptide
QVQLQESGPGLVKSSQTLSLNCSVFGASISSGGYYWTWIRQHPGKGLEWIGYIHYRGTYYNPSLKSRVTMSVDTSKNQFSLKVRSVSAADTAIYYCARAIVVVTLNWFDLWGQGTLVTVSS

SEQ ID NO: 250 - protein, 110 aa, Artificial Sequence
  Description of Artificial Sequence: Synthetic polypeptide
NFMLTQPHSVSESPGKTVTISCSGSGGSIASNYVQWYQQRPGSAPTAVIYEDNQRPSGVPDRFSGSIDSSSNSASLTISGLKTEDEADYYCQSYDTSNPVIFGGGTKLTV

SEQ ID NO: 251 - protein, 120 aa, Artificial Sequence
  Description of Artificial Sequence: Synthetic polypeptide
QVQLQESGPGLVKPSETLSLTCTVSGGSVINGSYYWSWIRQPPGKGLEWIGFVYYSGSTNYNPSLKSRVTISVDTSKNQFSLNLNSVTAADTAVYYCATGSKSSYYFDYWGQGTLVTVSS

SEQ ID NO: 252 - protein, 111 aa, Artificial Sequence
  Description of Artificial Sequence: Synthetic polypeptide
QSVLTQPPSVSAAPGQKVTISCSGSSSNIGNNYVSWYQQLPGAAPKLLIYENNMRPSGIPDRFSGSKSGTSATLGITGLQTGDEADYYCGTWDSSLSVPYVFGTGTRVTVL

SEQ ID NO: 253 - protein, 123 aa, Artificial Sequence
  Description of Artificial Sequence: Synthetic polypeptide
QVQLVQSGAEVKKPGASVKVSCTASGYTFSSYYIHWVRQAPGQGLEWMGIINPGAGSTSYAQKFQGRVAMTTDTSTRTVYMELSSLRSDDTAVYYCARDEAFLPSAIFVGDYWGQGTLVTVSS

SEQ ID NO: 254 - protein, 109 aa, Artificial Sequence
  Description of Artificial Sequence: Synthetic polypeptide
DIQMTQSPSSLSASVGDRVTITCRASQGIRNDLGWYQQKPGKAPKRLIYAASNLQSGVPSRFSGSGSGTEFTLTISSLQPEDFATYYCLQHSTYPHTWTFGQGTKVEIK

SEQ ID NO: 255 - protein, 121 aa, Artificial Sequence
  Description of Artificial Sequence: Synthetic polypeptide
QVQLVESGGNVVQPGRSLRLSCAASGFTFSNYGMHWIRQAPGKGLEWVAVISYDGSDKYYADSVKGRVTISRDNSKNTLYLQMNSLRAEDTAVYYCAKGGPYGDHVRSDYWGLGTLVTVSS

SEQ ID NO: 256 - protein, 107 aa, Artificial Sequence
  Description of Artificial Sequence: Synthetic polypeptide
DIQMTQSPSSLSASVGDRVTITCQASQDISNYLNWYQQKPGKVPKLLIYDASNLETGVPSRFSGSGSGTDFTFTISSLQPEDIATYYCQQFHNLPLTFGQGTKLEIK

SEQ ID NO: 257 - protein, 122 aa, Artificial Sequence
  Description of Artificial Sequence: Synthetic polypeptide
QVQLQESGPGLVKPSETLSLTCTVSGASISSYYWSWIRQPPGKGLEWIGYIYYSGSTNYNPSLKSRVTISLDTSKNQFSLQLSSVTAADTAVYYCATYYFDNSGYSYGLDVWGQGTTVTVSS

SEQ ID NO: 258 - protein, 107 aa, Artificial Sequence
  Description of Artificial Sequence: Synthetic polypeptide
DIQMTQSPSSLSASVGDRVTIACRASQSISSYLHWYQQQPGKAPKLLIYAVTNLQSGVPSRFSGSGSGTDFTLTISSLQPEDFATYYCQQSYSLPQTFGQGTKVEIK

SEQ ID NO: 259 - protein, 117 aa, Artificial Sequence
  Description of Artificial Sequence: Synthetic polypeptide
EVQLVESGGGLIQPGGSLKLSCVVSGFTVSRNYISWVRQAPGKGLEWVSVLFAGGSTFYADSVKGRFAISRDNSNNTLFLQMNSLRVEDTAIYYCARGDGELIFDQWGQGTLVTVSS

SEQ ID NO: 260 - protein, 110 aa, Artificial Sequence
  Description of Artificial Sequence: Synthetic polypeptide
QSVLTQPPSVSGAPGQRVTIVCTGTSSNIGAGYDVHWYQQLPGRAPKVLVSGNNIRPSEVPDRFSGSRSGTSASLAITSLQPEDEAQYYCQSYDSNLYAVFGGGTKLTVL

SEQ ID NO: 261 - protein, 120 aa, Artificial Sequence
  Description of Artificial Sequence: Synthetic polypeptide
EVQLVESGGGLIKPGRSLRLSCTASGFTFGDYAMTWFRQAPGKGLEWVGFIRSKAYGGTTGYAASVKYRFTISRDDSKSIAYLQMDSLKTEDTAVYYCTRWDGWSQHDYWGQGTLVTVSS

SEQ ID NO: 262 - protein, 111 aa, Artificial Sequence
  Description of Artificial Sequence: Synthetic polypeptide
DIVMTQSPLSLSVTPGEPASISCRSSQSLLHSNGNNYFDWYLQKPGQSPQLLIYLASNRASGVPDRFSGSGSGTDFTLKISRVEAEDVGVYYCMQVLQIPYTFGQGTKLEI

SEQ ID NO: 263 - protein, 120 aa, Artificial Sequence
  Description of Artificial Sequence: Synthetic polypeptide
QVQLQESGPGLVKPSGTLSLTCAVSGGSISTVNWWSWVRQPPGKGLEWIGEIHHSGNTNHNPSLRSRVTISVDKSKNQFSLKLRSVTAADTAVYYCARDGGRPGDAFDLWGQGTMVTVSS

SEQ ID NO: 264 - protein, 109 aa, Artificial Sequence
  Description of Artificial Sequence: Synthetic polypeptide
QSALTQPASVSGSPGQSITISCTGTSSDVGGYNYVSWYQQHPGKVPKVMIYDVSNRPSGISNRFSGSKSGNTASLTISGLQAEDEADYYCNSYRSNSTRVFGTGTKVTV

SEQ ID NO: 265 - protein, 122 aa, Artificial Sequence
  Description of Artificial Sequence: Synthetic polypeptide
QVQLVQSGAEVKKPGASVKVSCKASGYTFTSYGFSWVRQAPGQGLEWLGWISAYNGNTNYAQKLQGRVTMTTDTSTSTAYMELRSLRSDDTAVYYCARAIAVAGTSGEFDYWGQGTLVTVSS

SEQ ID NO: 266 - protein, 111 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGHVVFGGGTKLTVL

SEQ ID NO: 267 - protein, 122 aa, Artificial Sequence
  Description of Artificial Sequence: Synthetic polypeptide
QVQLVQSGAEVKKPGASVMLSCKASGYTFTSYGISWVRQAPGQGLEWMGWISAYNGNTNYAQKLQGRVSMTTDTSTSTAYMELRSLRSDDTAVYYCARAMAVAGTSGDFDYWGQGTLVTVSS

SEQ ID NO: 268 - protein, 111 aa, Artificial Sequence; identical to SEQ ID NO: 266
  Description of Artificial Sequence: Synthetic polypeptide

SEQ ID NO: 269 - protein, 122 aa, Artificial Sequence
  Description of Artificial Sequence: Synthetic polypeptide
QVQLVQSGAEVKKPGSSVKVSCKASGGTFSIYAISWVRQAPGQGLEWMGGIIPILGTANYAQKFQGRVTITADESTSTAYMELSSLRSEDTAVYYCASFHVAYGDYIPFDYWGQGTLVTVSS

SEQ ID NO: 270 - protein, 109 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEREDFAVYYCQQYGRSPTWTFGQGTKVEIK

SEQ ID NO: 271 - protein, 122 aa, Artificial Sequence
  Description of Artificial Sequence: Synthetic polypeptide
QVQLVQSGAEVKKPGSSVKVSCKASGDTFSIYAFSWVRQAPGQGLQWMGAIIPLLGTTNYAQKFLGRVTITADESTSTTFMELSSLTSEDTAVYHCATFHVAYGDYIPFDSWGQGTLVIVSS

SEQ ID NO: 272 - protein, 109 aa, Artificial Sequence
  Description of Artificial Sequence: Synthetic polypeptide
EIVLTQSPGTLSLSPGERATLSCRASQSVTSSYLAWYQQKPGQAPRLLIYGASSRATGIPDRFSGSGSGTDFTLTISRLEPEDFAVYYCQQYGRSPTWTFGQGTKVEIK

SEQ ID NO: 273 - protein, 124 aa, Artificial Sequence
  Description of Artificial Sequence: Synthetic polypeptide
QVQLVESGGGVVQPGRSLRLSCAASGFTFSSSGMHWVRQAPGKGLEWVAIISYDGSNKYYADSVKGRFTISRDNSKNTLSLQMNSLRAEDTAVYYCAKDPLPFRDFFYYYMDVWGKGTTVTVSS

SEQ ID NO: 274 - protein, 111 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLGVFGTGTKVTVL

SEQ ID NO: 275 - protein, 124 aa, Artificial Sequence
  Description of Artificial Sequence: Synthetic polypeptide
QVQLVESGGGVVQPGRSLRLSCAASGFTFSNYGMHLVRQAPGKGLEWVAIISYDGSNKYYADSVKGRFTISRDSSKNTLYLQMNNLRAEDTAVYYCAKDPLPFRDYYYYYMDVWGKGTTVTVSS

SEQ ID NO: 276 - protein, 111 aa, Artificial Sequence; identical to SEQ ID NO: 274
  Description of Artificial Sequence: Synthetic polypeptide

SEQ ID NO: 277 - protein, 123 aa, Artificial Sequence
  Description of Artificial Sequence: Synthetic polypeptide
EVQLVQSGAEVKKAGESLKISCNSSGYSFTNYWIAWVRQVPGKGLEWMGIIYLGDSDTRYSPSFQGRVTISADKSISAAYLHWSSLKASDTAIYYCARGGPPGGVKLELTDFWGQGTLVTVSS

SEQ ID NO: 278 - protein, 111 aa, Artificial Sequence
  Description of Artificial Sequence: Synthetic polypeptide
QSVLTQPPSASGTPGQRVTISCSGSNSNIGDNTVHWYQQLPGTAPKLLIFNNNQRPSGVPDRFSGSKSGTSASLAISGLQSDDEADYYCAAWDDSLDGPVVFGGGTKLTVL

SEQ ID NO: 279 - protein, 123 aa, Artificial Sequence
  Description of Artificial Sequence: Synthetic polypeptide
EVQLVQSGAEVKKPGESLKISCKGSGYRFTSYWIAWVRQMPGKGLEWMGIIYPGDSDTRYSPSFQGQVTISADQSISTAYLQWSSLKASDTAMYYCARGGPPGGVKLELTDYWGQGALVTVSS

SEQ ID NO: 280 - protein, 111 aa, Artificial Sequence
  Description of Artificial Sequence: Synthetic polypeptide
QSVLTQPPSASGTPGQRVTISCSGSSSNIGSNTVNWYQQLPGTAPQLLIYNNYQRPSGVPDRFSGSKSGTSASLAISGLQSEDEADYYCAAWDDSLNGPVVFGGGTKLTVL

SEQ ID NO: 281 - protein, 117 aa, Artificial Sequence
  Description of Artificial Sequence: Synthetic polypeptide
QVQLVESGGGVVQPGRSLRLSCVASGFTFSYFDMHWVRQAPGKGLEWVALISHDGSTTFYGDSARGRFTISRDNSRNTLDLQMNSLRPEDTAVYFCAKPVDAAMFDFWGQGTLVTVS

SEQ ID NO: 282 - protein, 109 aa, Artificial Sequence
  Description of Artificial Sequence: Synthetic polypeptide
SYELTQPPSVSVAPGKTARITCGGNNIGSKSVHWYQQRPGQAPVLVIYYDSDRPSGIPERFSGSNSGNTATLTISRVEAGDEADFYCQVWDRSTNHLVVFGGGTQLTVL

SEQ ID NO: 283 - protein, 119 aa, Artificial Sequence
  Description of Artificial Sequence: Synthetic polypeptide
EVQLVESGGGLIQPGGSLRLSCAASILTVSRNYMSWVRQAPGKGLEWVSSIYSGGTTYYADSVKGRFTISRDDSKNTLYLQMNSLRAEDTAVYYCARPVVGGRAGMDVWGQGTTVTVSS

SEQ ID NO: 284 - protein, 107 aa, Artificial Sequence
  Description of Artificial Sequence: Synthetic polypeptide
DIQMTQSPSSLSASVGDRVTITCQASQDINKYLNWYQQKPGKAPKLLIYDASNLETGVPSRFSGSGSGTDFTFTISSLQPEDIGTFYCLHNDNPPLTFGGGTKVEIK

SEQ ID NO: 285 - protein, 123 aa, Artificial Sequence
  Description of Artificial Sequence: Synthetic polypeptide
EVQLVESGGGLVQPGGSLRLSCAASGFTFSTYDMHWVRQATGKGLEWVSAIGTAGDKYYPGSVKGRFTISRENAKNSLYLQMNSLRAGDTAVYYCVRAGYSSGWPLYWYFDLWGRGTLVTVSS

SEQ ID NO: 286 - protein, 109 aa, Artificial Sequence
  Description of Artificial Sequence: Synthetic polypeptide
DIQMTQSPSSLSASVGDRVTITCRASQSISSYLNWYQQKPGKAPKFLIYAASSLQSGVPSRFSGSGSGTDFTLTISNLQPEDFATYYCQQSYRTPPEFTFGPGTKVDIK

SEQ ID NO: 287 - protein, 118 aa, Artificial Sequence
  Description of Artificial Sequence: Synthetic polypeptide
QVQLQESGPGLVKPSETLSLTCTVSGDSISSYFWSWIRQPPGRGLEWIGYIHDSVNTNYNPSLKSRVTISVDTSKSQFSLRLSSVTAADTAVYYCARCAWLRGSFDYWGQGTLVTVSS

SEQ ID NO: 288 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDFSSHYVFGTGTKVTVL

SEQ ID NO: 289 - protein, 115 aa, Artificial Sequence
  Description of Artificial Sequence: Synthetic polypeptide
EVQLVESGGGLIQPGGSLRLSCTASGLIVSSNYMSWIRQAPGKGLEWVSLIYSGGSTFYADSVKGRFTISRDNSKNTLFLHMNSLRAEDTAVYYCARHPYGTDVWGQGTTVTVSS

SEQ ID NO: 290 - protein, 107 aa, Artificial Sequence
  Description of Artificial Sequence: Synthetic polypeptide
DIQMTQSPSSLSASVGDRVTITCQASQDIVKYLNWYQQKSGKAPKLLIHDASNLETGVTSRFSGSGSGTHFTFTISSLQPEDLATYYCQQYDNLPITFGQGTRLEIK

SEQ ID NO: 291 - protein, 124 aa, Artificial Sequence
  Description of Artificial Sequence: Synthetic polypeptide
QVQLVQSGAEVKKSGSSVKVSCKASGGSFSSYAISWVRQAPGQGLEWMGGIIPIFGTAKYAQKFQGRVTITADESTSTAYMELSSLRSEDTAVYYCASRWEQLNGGSWHYFDYWGQGTLVTVSS

SEQ ID NO: 292 - protein, 112 aa, Artificial Sequence
  Description of Artificial Sequence: Synthetic polypeptide
QSALTQPASVSGSPGQSITISCTGTRSDVGRNNLVSWYQHHPGKAPKVMIYEGSKRPSGVSTRFSGSKSGNTASLTISGLQAEDEADYYCCSYAGSSTFEGVFGGGTKLTVL

SEQ ID NO: 293 - protein, 125 aa, Artificial Sequence
  Description of Artificial Sequence: Synthetic polypeptide
EVQLVESGGGLVQPGGSLKLSCAASGFTFSGSAMHWVRQASGKGLEWVGRIRNKANSYATAYGASVRGRFTVSRDDSKNTAYLQMNSLKIEDTAVYYCTKDIAAGIPALNWFDSWGQGTLVTVSS

SEQ ID NO: 294 - protein, 109 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQHTNWPPRITFGGGTKVEIK

SEQ ID NO: 295 - protein, 125 aa, Artificial Sequence
  Description of Artificial Sequence: Synthetic polypeptide
QVQLQESGPGLVKPSQTLSLTCTVSGGSISSGDYYWSWIRQPPGKGLEWIGYIYYSGSTNYNPSLRSRVTISVDTSKNQFSLRLRSVTAADTAVYYCARDAIGSASYGVEYFQHWGQGTLVTVSS

SEQ ID NO: 296 - protein, 109 aa, Artificial Sequence
  Description of Artificial Sequence: Synthetic polypeptide
EIVLTQSPGTLSLSPGERATLSCRASQSVSSRYLAWYQQKPGQAPRLLIYGASSRATGIPDRFSGSGSGTEFTLTISRLEPEDFAVYYCQQYGSSPPYTFGQGTKLEIK

SEQ ID NO: 297 - protein, 120 aa, Artificial Sequence
  Description of Artificial Sequence: Synthetic polypeptide
QVQLVQSGAEVKKPGASVKVSCKVSGYNLTELSMYWVRQAPGKGLEWMGGFDPEDGGPIHAQKFQGRVTMTEDPSTDTAYMELRSLRSEDTALYYCATGGLFMIRGLEIWGRGTLVTVSS

SEQ ID NO: 298 - protein, 109 aa, Artificial Sequence
  Description of Artificial Sequence: Synthetic polypeptide
EIVLTQSPGTLSLSPGERATLSCRASQSISYTSLAWYQQKPGQAPRLLIFGASRGATGTPDRFSGSWSGTDFTLTISRLEPEDFAVYYCQQYGNSPRLSFGGGTKVEIK

SEQ ID NO: 299 - protein, 125 aa, Artificial Sequence
  Description of Artificial Sequence: Synthetic polypeptide
QVQLVQSGAEVKKPGASVKVSCKASGYILTDYFIHWVRQAPGQGLEWMGWINPNSGGTNYAQKFQGRVTMTRDTSISTAYMELSRLRSDDTAVYHCARYKGTTVNTNYYYGMDVWGQGTTVTVSS

SEQ ID NO: 300 - protein, 106 aa, Artificial Sequence
  Description of Artificial Sequence: Synthetic polypeptide
SYELTQPPSVSVSPGQTASITCSGDKLGDKYACWYQQKAGQSPVLVIYQDSKRPSGIPERFSGSKSGNTATLTISGTQAMDEADYYCQAWDSSTVVFGGGTKLTVL

SEQ ID NO: 301 - protein, 125 aa, Artificial Sequence
  Description of Artificial Sequence: Synthetic polypeptide
QVQLVQSGAEVKKPGASVKVSCKASGYTFTDYFNHWVRQAPGQGLEWMGWINPNSGGTNSAQKFQGRVTMTRDTSITTVYMELSRLRSDDTAVYYCARYKGTTVNTNYYYGMDVWGQGTTVTVSS

SEQ ID NO: 302 - protein, 106 aa, Artificial Sequence
  Description of Artificial Sequence: Synthetic polypeptide
SYELTQPPSVSVSPGQTASITCSGDKLRNKYACWYQQKAGQSPMLVIYQDTKRPSGIPERFSGSNSGNTATLTISGTQAMDEADYYCQAWDISTVVFGGGTKLTVL

SEQ ID NO: 303 - protein, 123 aa, Artificial Sequence
  Description of Artificial Sequence: Synthetic polypeptide
QVQLVQSGAEVKKPGASVKVSCKASGYTFTSYDINWVRQAPGQGLEWMGWMNPNSGNTDYAQKFQGRFTMTRNTSISTAYMELSSLRSEDTAVYYCASRRWDPLTFYYYMVVWGKGTTVTVSS

SEQ ID NO: 304 - protein, 112 aa, Artificial Sequence
  Description of Artificial Sequence: Synthetic polypeptide
DIVMTQSPLPLPVTPGEPASISCRSSQSLLYSNGYNYLDWYLQKPGQSPQLLIYLGSNRASGVPDRFSGSGSGTDFTLKISRVEAEDVGVYFCMQALQTPPTFGGGTKVEIK

SEQ ID NO: 305 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVISDDGSNKYYADSVKGRFTISRDNSKNTLYLQMNSLRAEDTAVYYCAKSWWLSENWFDPWGQGTLVTVSS

SEQ ID NO: 306 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGTGSGTEFTLTISSLQSEDFAVYYCQQYNNWPLTFGGGTKVEIK

SEQ ID NO: 307 - protein, 120 aa, Artificial Sequence
  Description of Artificial Sequence: Synthetic polypeptide
QVQLVESGGGVVQAGRSLRLSCAASGFTFSSFGLHWVRQAPGKGLEWVAVISDDGANKYYADSVKGRFTISRDNSKNTLYLQMNSLRADDTAKYYCAKSWWLSENWFDPWGQGTLVTVSS

SEQ ID NO: 308 - protein, 107 aa, Artificial Sequence
  Description of Artificial Sequence: Synthetic polypeptide
EIVMTQSPATLSVSPGERATLSCRASQSVRSNLAWYQQKPGQAPRLLIYGASTRATGIPARFSGSGSGTDFTLTISSLQSEDFAVYYCQQYNNWPLTFGGGTKVEIK

SEQ ID NO: 309 - protein, 123 aa, Artificial Sequence
  Description of Artificial Sequence: Synthetic polypeptide
QVQLVESGGGVVQPGRSLRLSCAASGITFSHYGMHWVRQAPGKGLEWVALISSDGSKKYYADSVKGRFTISRDNSKSTLYLQMNSLRAEDTAIYYCAKDLGYYYGPPYGPDYWGQGTLVTVSS

SEQ ID NO: 310 - protein, 108 aa, Artificial Sequence
  Description of Artificial Sequence: Synthetic polypeptide
DIQMTQSPSSLSASVGDRVTITCQASQDVSNSLNWYQQKPGKAPKLLIYDASNLETGVPSRFSGSGSGTDFSFTISSLQPEDIATYYCLQYDNFSMYTFGQGTKLEIK

SEQ ID NO: 311 - protein, 119 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGVAVDWYFDLWGRGTLVTVSS

SEQ ID NO: 312 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALYVFGTGTKVTVL

SEQ ID NO: 313 - protein, 122 aa, Artificial Sequence
  Description of Artificial Sequence: Synthetic polypeptide
QVQLQESGPGLVKPSGTLSLTCAVSGGSISSNNWWSCVRQPPGKGLEWIGEIYHSGSTNYNPSLKSRVTISVDKSKNQFSLKLSSVTAADTAVYYCARGGDTAMGPEYFDYWGQGTLVTVSS

SEQ ID NO: 314 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLFGGGTKLTVL

SEQ ID NO: 315 - protein, 129 aa, Artificial Sequence [sequence omitted]

SEQ ID NO: 316 - protein, 110 aa, Artificial Sequence
  Description of Artificial Sequence: Synthetic polypeptide
QSALTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL

SEQ ID NO: 317 - protein, 131 aa, Artificial Sequence
  Description of Artificial Sequence: Synthetic polypeptide
EVQLVESGGGLIQPGGSLRLSCAASGFTVSNNYMSWVRQAPGKGLEWVSVIYSGGSTYYADSVKGRFTISRDKSKNTLYLQMNRLRAEDTAVYYCAREGEVEGYNDFWSGYSRDRYYFDYWGQGTLVTVSS

SEQ ID NO: 318 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 319 - protein, 122 aa, Artificial Sequence; identical to SEQ ID NO: 77
  Description of Artificial Sequence: Synthetic polypeptide

SEQ ID NO: 320 - protein, 110 aa, Artificial Sequence; identical to SEQ ID NO: 78
  Description of Artificial Sequence: Synthetic polypeptide

SEQ ID NO: 321 - protein, 129 aa, Artificial Sequence [sequence omitted]

SEQ ID NO: 322 - protein, 110 aa, Artificial Sequence
  Description of Artificial Sequence: Synthetic polypeptide
QSALTQPASVSGSPGQSITISCTGTSNDVGSYTLVSWYQQYPGKAPKLLIFEVTKRSSGISNRFSGSKSGNTASLTISGLQGEDEADYYCCSYAGASTFVFGGGTKLTVL

SEQ ID NO: 323 - protein, 128 aa, Artificial Sequence; identical to SEQ ID NO: 139
  Description of Artificial Sequence: Synthetic polypeptide

SEQ ID NO: 324 - protein, 21 aa, Artificial Sequence
  Description of Artificial Sequence: Synthetic peptide
AKDTPGGDDILTGWGLYGMDV

SEQ ID NO: 325 - protein, 107 aa, Artificial Sequence
  Description of Artificial Sequence: Synthetic polypeptide
DIQMTQSPSSLSASVGDRVTITCQASQDISNYLNWYQHHPGKAPKLLIHDASILETGVPTRFSGTGSGTKFTFTISSLQPEDIATYYCQQYHYLPPHFGPGTKVDSK

SEQ ID NO: 326 - protein, 9 aa, Artificial Sequence
  Description of Artificial Sequence: Synthetic peptide
QQYHYLPPH

SEQ ID NO: 327 - protein, 125 aa, Artificial Sequence
  Description of Artificial Sequence: Synthetic polypeptide
QVQLVESGGGLVKPGGSLRLSCAASGFTFSDYCVTWIRQAPGKGLEWLSYSNTNDSSRSYADSVKGRFTISRDNAKNSLYLQMDSLRAEDTAVYYCARRGDGNVPLFHYYYMDVWGKGTTVTVSS

SEQ ID NO: 328 - protein, 18 aa, Artificial Sequence
  Description of Artificial Sequence: Synthetic peptide
ARRGDGNVPLFHYYYMDV

SEQ ID NO: 329 - protein, 110 aa, Artificial Sequence
  Description of Artificial Sequence: Synthetic polypeptide
QSVLTQPPSASGTAGQRVTISCSGGSSNIGSNTVHWYQQLPGTAPKLLIYSNYKRPSGVPDRFSGSKSGASASLAISGLQSEDEAEYYCAAWDDSANGPIFGGGTKLTVL

SEQ ID NO: 330 - protein, 11 aa, Artificial Sequence
  Description of Artificial Sequence: Synthetic peptide
AAWDDSANGPI

SEQ ID NO: 331 - protein, 120 aa, Artificial Sequence
  Description of Artificial Sequence: Synthetic polypeptide
QVQLVQSGAEVGKPGSSVRLSCKASRGTFNIYSISWLRQSPGQGLEWVGVITPLFGSSNYAHEFQGRVTLTADESTNTAYMDLSSLTSEDTALYYCATGGESGTSWFDPWGQGTLLTVSS

SEQ ID NO: 332 - protein, 13 aa, Artificial Sequence
  Description of Artificial Sequence: Synthetic peptide
ATGGESGTSWFDP

SEQ ID NO: 333 - protein, 110 aa, Artificial Sequence
  Description of Artificial Sequence: Synthetic polypeptide
QSVLTQPPSASGTPGQRVTISCSGSSSNIGSHPVHWYQQLPGMAPKLLIYISNQRPSGVPDRFSGSKSGTSASLAISGLQSEDEADYYCAAWDDSQNGWVFGGGTKLTVL

SEQ ID NO: 334 - protein, 11 aa, Artificial Sequence
  Description of Artificial Sequence: Synthetic peptide
AAWDDSQNGWV

SEQ ID NO: 335 - protein, 124 aa, Artificial Sequence; identical to SEQ ID NO: 155
  Description of Artificial Sequence: Synthetic polypeptide

SEQ ID NO: 336 - protein, 17 aa, Artificial Sequence
  Description of Artificial Sequence: Synthetic peptide
ARPLLPGETGSLNRLDY

SEQ ID NO: 337 - protein, 110 aa, Artificial Sequence
  Description of Artificial Sequence: Synthetic polypeptide
QSVLTQPPSVSEAPRQRVTISCSGSSANIENNGVNWYQQLPGKAPKLLIYNDDLLFSGVSDRFSGSKSGTSASLAISGLQSEDEADYYCATWDDSLNGPVFGGGTKLTVL

SEQ ID NO: 338 - protein, 11 aa, Artificial Sequence
  Description of Artificial Sequence: Synthetic peptide
ATWDDSLNGPV

SEQ ID NO: 339 - protein, 121 aa, Artificial Sequence; identical to SEQ ID NO: 57
  Description of Artificial Sequence: Synthetic polypeptide

SEQ ID NO: 340 - protein, 14 aa, Artificial Sequence
  Description of Artificial Sequence: Synthetic peptide
ARGVVGATPGSFDL

SEQ ID NO: 341 - protein, 109 aa, Artificial Sequence
  Description of Artificial Sequence: Synthetic polypeptide
QSVLTQPASVSGSPGQSITISCTGTSSDVGNYNLVSWYQQHPGKAPKLMIYGVSKRPSGVSYRFSGSKSANTASLTISGLQAEDEADYYCCSYAGSSVIFGGGTKLTVL

SEQ ID NO: 342 - protein, 9 aa, Artificial Sequence
  Description of Artificial Sequence: Synthetic peptide
CSYAGSSVI

SEQ ID NO: 343 - protein, 122 aa, Artificial Sequence
  Description of Artificial Sequence: Synthetic polypeptide
QVQLQESGPGLVKPSQTLSLTCSVSGASISNADYYWSWIRQPPGKGLEWIGYIYYSGTSYYNPSLKSRVTISVDTSKNQFSLKLSSVTAADTAVYYCARELRWSLGGGASYWGQGTLVTVSS

SEQ ID NO: 344 - protein, 14 aa, Artificial Sequence
  Description of Artificial Sequence: Synthetic peptide
ARELRWSLGGGASY

SEQ ID NO: 345 - protein, 110 aa, Artificial Sequence
  Description of Artificial Sequence: Synthetic polypeptide
QSVLTQPASESGSPGQSITISCTGTSSDVGSYNLVSWYQQHPGKAPKLMIYEGIKRPSGVSNRFSGSKSGNTASLTISGLQAEDEADYYCCSYAGSTNVIFGGGTKLTVL

SEQ ID NO: 346 - protein, 10 aa, Artificial Sequence
  Description of Artificial Sequence: Synthetic peptide
CSYAGSTNVI

SEQ ID NO: 347 - protein, 126 aa, Artificial Sequence
  Description of Artificial Sequence: Synthetic polypeptide
EVQLLESGGDLVHPGGSLRLSCAASGFTFRSYAMSWVRQAPGKGLEWVSSVSGAGGSTYYADSVKGRFTISRDNSKNTLFMHMNSLRAEDTAVYYCVRTRMDYYDSIGYPWAFEIWGQGTMVTVSS

SEQ ID NO: 348 - protein, 19 aa, Artificial Sequence
  Description of Artificial Sequence: Synthetic peptide
VRTRMDYYDSIGYPWAFEI

SEQ ID NO: 349 - protein, 108 aa, Artificial Sequence
  Description of Artificial Sequence: Synthetic polypeptide
QSVLTQPASESGSPGQSITISCTGTNSDVGSYDLVSWYQQHPGKAPKLIIYEVNKRPSGVSSRFSGSKSGNTASLTISGLQIEDEADYYCCSYAGTWLFGGGTRLTVL

SEQ ID NO: 350 - protein, 8 aa, Artificial Sequence
  Description of Artificial Sequence: Synthetic peptide
CSYAGTWL

SEQ ID NO: 351 - protein, 121 aa, Artificial Sequence
  Description of Artificial Sequence: Synthetic polypeptide
QVQLVESGGGVVQPGGSLRLSCAASGFTFSNHGMHWVRQAPGKGLEWVAVMSYDGSNEDYSASVKGRFTISRDNSKNTLSLQMNSLRPEDTAVYYCASEDYYDSSGSFDNWGQGTLVTVSS

SEQ ID NO: 352 - protein, 14 aa, Artificial Sequence
  Description of Artificial Sequence: Synthetic peptide
ASEDYYDSSGSFDN

SEQ ID NO: 353 - protein, 110 aa, Artificial Sequence
  Description of Artificial Sequence: Synthetic polypeptide
QYVLTQPRSVSGSPGQSVTISCTGTSSDVGGSNYVSWYQQHPGKAPKVMVYDVRKRPSGVPDRFSGSKSGNTASLTISGLQPEDEADYYCCSYAGTYTWVFGGGTTLTVL

SEQ ID NO: 354 - protein, 10 aa, Artificial Sequence
  Description of Artificial Sequence: Synthetic peptide
CSYAGTYTWV

SEQ ID NO: 355 - protein, 128 aa, Artificial Sequence; identical to SEQ ID NO: 139
  Description of Artificial Sequence: Synthetic polypeptide

SEQ ID NO: 356 - protein, 21 aa, Artificial Sequence
  Description of Artificial Sequence: Synthetic peptide
AKDTPGGDDILTGWGLYGMDV

SEQ ID NO: 357 - protein, 110 aa, Artificial Sequence
  Description of Artificial Sequence: Synthetic polypeptide
QSVLTQPASVSGSPGQSITISCTGTSSDVGSYNLVSWYQQYPGKAPKLMIYEVSKRPSGVSNRFSGSKSGNTASLTISGLRAEDEADYYCCSYVGSSTRVFGGGTKLTVL

SEQ ID NO: 358 - protein, 10 aa, Artificial Sequence
  Description of Artificial Sequence: Synthetic peptide
CSYVGSSTRV

SEQ ID NO: 359 - protein, 130 aa, Artificial Sequence
  Description of Artificial Sequence: Synthetic polypeptide
QVQLVQSGAEVKKPGASVTVSCKASGYIFTDYYMHWVRQAPGQGLEWMGWINPNSGGANYAQKFQGRISMTTDTSVTTGYMDLSRLRSDDTAVYYCAIKPPTYHFDNNGYHLPYDYVDVWGTGTTVTVAS

SEQ ID NO: 360 - protein, 23 aa, Artificial Sequence
  Description of Artificial Sequence: Synthetic peptide
AIKPPTYHFDNNGYHLPYDYVDV

SEQ ID NO: 361 - protein, 111 aa, Artificial Sequence
  Description of Artificial Sequence: Synthetic polypeptide
QSVLTQPPSVSAAPGQKVTISCSGSSSNIGNYYVSWYQQLPGTAPKLLIYDNNKRPSGIPDRFSGSKSGTSATLGITGLQTGDEADYYCGTWDNSLSTDWVFGGGTKLTVL

SEQ ID NO: 362 - protein, 12 aa, Artificial Sequence
  Description of Artificial Sequence: Synthetic peptide
GTWDNSLSTDWV

SEQ ID NO: 363 - protein, 129 aa, Artificial Sequence
  Description of Artificial Sequence: Synthetic polypeptide
QVQLVQSGAEVKKPGTSVKVSCKASGYTFTDYFMHWVRQAPGQGLEWMGWINPNSGGTNYAQNFQGRVTMTSDTSITTAYMELSRLRSDDTAVYYCAIKPPIYYYDSSGSFLSYYYMDVWGKGTTVTVS

SEQ ID NO: 364 - protein, 23 aa, Artificial Sequence
  Description of Artificial Sequence: Synthetic peptide
AIKPPIYYYDSSGSFLSYYYMDV

SEQ ID NO: 365 - protein, 111 aa, Artificial Sequence
  Description of Artificial Sequence: Synthetic polypeptide
QSVLTQPPSVSAAPGQKVSISCSGSSSNIGNHYVSWYQQFPGTAPKLLIYDNNKRPSGIPDRFSGSKSGTSATLGIAGLQTGDEADYYCGTWDSSLSADWVFGGGTKLTVL

SEQ ID NO: 366 - protein, 12 aa, Artificial Sequence
  Description of Artificial Sequence: Synthetic peptide
GTWDSSLSADWV

SEQ ID NO: 367 - protein, 120 aa, Artificial Sequence
  Description of Artificial Sequence: Synthetic polypeptide
QVQLVQSGTELVKPGASVNLSCKASGYTFTSYWMHWVKQRPGQGLEWIGNINPSNGGTNYNEKFKNKATLTVDKSSSTAYMQLSSLTSEDSAVYYCARPPYYSNFLFVYWGQGTTVTVSS

SEQ ID NO: 368 - protein, 13 aa, Artificial Sequence
  Description of Artificial Sequence: Synthetic peptide
ARPPYYSNFLFVY

SEQ ID NO: 369 - protein, 109 aa, Artificial Sequence
  Description of Artificial Sequence: Synthetic polypeptide
QSVLTQEPSLTVSPGGTVTLTCASSTGAVTSDSYPNWFQQKPGQPPRALIYSTSNKHSWTPARFSGSLLGGKAALTLSGVQPEDEADYYCLLYDGDAVLFGGGTKLTVL

SEQ ID NO: 370 - protein, 9 aa, Artificial Sequence
  Description of Artificial Sequence: Synthetic peptide
LLYDGDAVL

SEQ ID NO: 371 - protein, 123 aa, Artificial Sequence; identical to SEQ ID NO: 235
  Description of Artificial Sequence: Synthetic polypeptide

SEQ ID NO: 372 - protein, 16 aa, Artificial Sequence
  Description of Artificial Sequence: Synthetic peptide
AKGGDFWSGYLIPFDS

SEQ ID NO: 373 - protein, 108 aa, Artificial Sequence
  Description of Artificial Sequence: Synthetic polypeptide
SYVLTQSPSVSVAPGKTARITCGGDSIGSKNVHWYQQKPGQAPVLVMYYDNDRPSGIPERFSGYNSGNTATLSISRVEAGDEADYYCLVWDGSGDPWVFGGGTKLTVL

SEQ ID NO: 374 - protein, 11 aa, Artificial Sequence
  Description of Artificial Sequence: Synthetic peptide
LVWDGSGDPWV

SEQ ID NO: 375 - protein, 122 aa, Artificial Sequence
  Description of Artificial Sequence: Synthetic polypeptide
QVQLVQSGAEVKKPGASVKVSCKTSGYLFTGYYIHWVRQAPGHGLEWMGWVNPNSGATNNTQKFQGRITMTRDTSITTVHMELSRLKSDDTAVYYCARDFDFSVVSNAFDIWGQGTMVTVSS

SEQ ID NO: 376 - protein, 15 aa, Artificial Sequence
  Description of Artificial Sequence: Synthetic peptide
ARDFDFSVVSNAFDI

SEQ ID NO: 377 - protein, 110 aa, Artificial Sequence
  Description of Artificial Sequence: Synthetic polypeptide
QSVLTQPPSASGSPGQSVTISCTGTSSDVGGYNYVSWYQQHPDKAPKLMIYEVSKRPSGVPDRFSGSKSGNTASLTVSGLQAEDEADYYCNSYAGNNILVFGGGTKLTVL

SEQ ID NO: 378 - protein, 10 aa, Artificial Sequence
  Description of Artificial Sequence: Synthetic peptide
NSYAGNNILV

SEQ ID NO: 379 - protein, 122 aa, Artificial Sequence
  Description of Artificial Sequence: Synthetic polypeptide
QVQLVQSGAEVKKPGASVKVSCKASGYLFTGHYIHWVRQAPGQGLEWMAWINPNSGATNYTQKFQGRVTMTRDTSITTTFMELSRLRSDDTAVYYCARDLGWSRVQGSLDIWGQGTIVTVSS

SEQ ID NO: 380 - protein, 15 aa, Artificial Sequence
  Description of Artificial Sequence: Synthetic peptide
ARDLGWSRVQGSLDI

SEQ ID NO: 381 - protein, 110 aa, Artificial Sequence
  Description of Artificial Sequence: Synthetic polypeptide
QSVLTQPPSASGSPGQSVTISCTGTSSDVGGYDFVSWYQQHPGKAPKLIIYEVNQRPSGVPDRFSGSKSGDSASLTVSGLQTEDEADYYCNSYAGNNNWVFGGGTKLTVL

SEQ ID NO: 382 - protein, 10 aa, Artificial Sequence
  Description of Artificial Sequence: Synthetic peptide
NSYAGNNNWV

SEQ ID NO: 383 - protein, 123 aa, Artificial Sequence
  Description of Artificial Sequence: Synthetic polypeptide
QVQLVQSGAEVKKPGASVMVSCRTSGYRITDYYIHWVRQAPGQGLEWMGWINPISGGTNYAQKFQGRVTMTRDTSILTAYMELTRLRSDDTAVYYCARGTFYYDSSGYYIDYWGQGTLVTVSS

SEQ ID NO: 384 - protein, 16 aa, Artificial Sequence
  Description of Artificial Sequence: Synthetic peptide
ARGTFYYDSSGYYIDY

SEQ ID NO: 385 - protein, 111 aa, Artificial Sequence
  Description of Artificial Sequence: Synthetic polypeptide
QSVLTQPPSASGSPGQSVTISCTGTSSDVGGYNYVSWYQQHPGKAPKLLIYEVSKRPSGVPDRFSASKSGNTASLTVSGLQAEDEADYYCNSYAGSNNPVVFGGGTKLTVL

SEQ ID NO: 386 - protein, 11 aa, Artificial Sequence
  Description of Artificial Sequence: Synthetic peptide
NSYAGSNNPVV

SEQ ID NO: 387 - protein, 130 aa, Artificial Sequence
  Description of Artificial Sequence: Synthetic polypeptide
QVQLVQSGVEVKKPGASVKVSCKSSGYTFTSYGINWVRQAPGQGLEWMGWINGYNGNTNYAQKFQGRVTMTSDTSTSTAYMQLSSLRSDDTAVYFCARGVISMVRGVPSLPQYNYGMDVWGQGTTVTVSS

SEQ ID NO: 388 - protein, 23 aa, Artificial Sequence
  Description of Artificial Sequence: Synthetic peptide
ARGVISMVRGVPSLPQYNYGMDV

SEQ ID NO: 389 - protein, 106 aa, Artificial Sequence
  Description of Artificial Sequence: Synthetic polypeptide
SYVLTQPPSVSVSPGQTASITCSGDDLGDKYACWYQQKPGQSPVLVIYHDFKRPSGIPERFSGSKSGNTATLTVSGTQAMDEADYYCQAWDSSTGVFGTGTKVTVL

SEQ ID NO: 390 - protein, 9 aa, Artificial Sequence
  Description of Artificial Sequence: Synthetic peptide
QAWDSSTGV

SEQ ID NO: 391 - protein, 120 aa, Artificial Sequence
  Description of Artificial Sequence: Synthetic polypeptide
QVQLVQSGAEVGKPGSSVKVSCKAPSGTFNIYSISWLRQSPGQGLEWVGAITPLFSSSNYAHKFQHRVTITADEATNTAYMELSSLTSEDTALYYCATGGESETTWFDPWGQGTLVTVSS

SEQ ID NO: 392 - protein, 13 aa, Artificial Sequence
  Description of Artificial Sequence: Synthetic peptide
ATGGESETTWFDP

SEQ ID NO: 393 - protein, 109 aa, Artificial Sequence
  Description of Artificial Sequence: Synthetic polypeptide
SYVLTQKPSVSVAPERAACLTCGGDNVASKDVQWCQLRPGQAPVVVIYSDSDRPPETPDRFSGSNSGNTASLTTSRVEAGDEADYYCQLCHSASGHPWVFGGGTNLTVL

SEQ ID NO: 394 - protein, 12 aa, Artificial Sequence
  Description of Artificial Sequence: Synthetic peptide
QLCHSASGHPWV

SEQ ID NO: 395 - protein, 117 aa, Artificial Sequence
  Description of Artificial Sequence: Synthetic polypeptide
EVQLVESGGGLVQPGGSLRLSCAASGFTFSSYWMHWVRQAPGKGLVWVSRINSYGSITNYADSVKGRFTISRDNAKNTLYLQMNSLRAEDTAVYYCARELFRTIDPWGQGTLVTVSS

SEQ ID NO: 396 - protein, 10 aa, Artificial Sequence
  Description of Artificial Sequence: Synthetic peptide
ARELFRTIDP

SEQ ID NO: 397 - protein, 110 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSFDSSSVVFGGGTKLTVL

SEQ ID NO: 398 - protein, 9 aa, Artificial Sequence
  Description of Artificial Sequence: Synthetic peptide
QSFDSSSVV

SEQ ID NO: 399 - protein, 114 aa, Artificial Sequence
  Description of Artificial Sequence: Synthetic polypeptide
QVQLVESGGGVVQPGRSLRLSCVASGITFRTYAMHWVRQAPGKGLEWVAVISYDGSNRHYADSVKGRFTISRDNSKNTLSLQMNSLRTEDTAVYYCATTLPNYWGRGTLVTVSS

SEQ ID NO: 400 - protein, 7 aa, Artificial Sequence
  Description of Artificial Sequence: Synthetic peptide
ATTLPNY

SEQ ID NO: 401 - protein, 110 aa, Artificial Sequence
  Description of Artificial Sequence: Synthetic polypeptide
NFMLTQPHSVSESPGKTVTISCTGSSGSIATNYVQWFQQRPGSAPTTVIYEDNQRPSGVPDRFSGSIDSSSNSASLTISGLKTEDEADYYCQSFDSSYWVFGGGTKLTVL

SEQ ID NO: 402 - protein, 9 aa, Artificial Sequence
  Description of Artificial Sequence: Synthetic peptide
QSFDSSYWV

SEQ ID NO: 403 - protein, 120 aa, Artificial Sequence
  Description of Artificial Sequence: Synthetic polypeptide
EVQLVESGGGLVQPGESLRLSCAGSGFTFSSHWMSWVRQAPGKGLEWVANIKEDGSADFYVDSVKGRFTISRDSAKNSLFLQMNSLRAEDTAVYYCARAVTGWFLGIDFWGQGTLVTVSS

SEQ ID NO: 404 - protein, 13 aa, Artificial Sequence
  Description of Artificial Sequence: Synthetic peptide
ARAVTGWFLGIDF

SEQ ID NO: 405 - protein, 111 aa, Artificial Sequence
  Description of Artificial Sequence: Synthetic polypeptide
NFMLTQPHSVSESPGKTVTISCTCSGGTIALNYVQWYQQRPGSAPTTVIYEDNQRPSGVPDRFSGSVDSSSNSASLSISGLKTEDEADYYCQSYDGNYHWVFGGGTKLTVL

SEQ ID NO: 406 - protein, 10 aa, Artificial Sequence
  Description of Artificial Sequence: Synthetic peptide
QSYDGNYHWV

SEQ ID NO: 407 - protein, 119 aa, Artificial Sequence
  Description of Artificial Sequence: Synthetic polypeptide
EVQLVESGGGLVQPGGSLRLSCAASGFTFSSYWMIWVRQAPGKGLEWVANIKLDGSEKKYVDSVKGRFTISRDNAKNSLYLQMNSLRAEDTAVYYCARASYYYGWFDPWGQGTLVTVSS

SEQ ID NO: 408 - protein, 12 aa, Artificial Sequence
  Description of Artificial Sequence: Synthetic peptide
ARASYYYGWFDP

SEQ ID NO: 409 - protein, 111 aa, Artificial Sequence
  Description of Artificial Sequence: Synthetic polypeptide
NFMLTQPHSVSESPGKTVTISCTGSSGSIASNYVQWYQQRPGSAPTNVIYEDNQRPSGVPDRFSGSIDSSSNSASLTISGLKTEDEADYYCQSYDGTNLWVFGGGTKLTVL

SEQ ID NO: 410 - protein, 10 aa, Artificial Sequence
  Description of Artificial Sequence: Synthetic peptide
QSYDGTNLWV

SEQ ID NO: 411 - protein, 119 aa, Artificial Sequence
  Description of Artificial Sequence: Synthetic polypeptide
QVQLVESGGGLVKPGGSLRLSCAASGFTFSDYYMSWIRQAPGKGLECVSYISTSGSAKNCADSVMGRFTISRDNAKNSLFLQMNSLRAEDTAVYYCAGQKWLRAPFDYWGQGILVTVSS

SEQ ID NO: 412 - protein, 12 aa, Artificial Sequence
  Description of Artificial Sequence: Synthetic peptide
AGQKWLRAPFDY

SEQ ID NO: 413 - protein, 111 aa, Artificial Sequence
  Description of Artificial Sequence: Synthetic polypeptide
NFMLTQPHSVSESPGKTVTISCTGSGGSIASNYVQWYQQRPGSAPRNVIYEDSQRPSGVPDRFSGSIDSSSNSASLTISGLKTEDEADYYCQSYDNIYHYVFGTGTQVTVL

SEQ ID NO: 414 - protein, 10 aa, Artificial Sequence
  Description of Artificial Sequence: Synthetic peptide
QSYDNIYHYV

SEQ ID NO: 415 - protein, 126 aa, Artificial Sequence
  Description of Artificial Sequence: Synthetic polypeptide
EVQLVQSGSEVKKPGESLKISCKASGYSFSYYWIGWVRQMPGKGLDWMGIIYPGDSATRYSPSFQGQVTISADKSISTAYLQWSSLKASDTAMYYCARLSYGHSGYTTVEDWFDPWGQGTLVTVSS

SEQ ID NO: 416 - protein, 19 aa, Artificial Sequence
  Description of Artificial Sequence: Synthetic peptide
ARLSYGHSGYTTVEDWFDP

SEQ ID NO: 417 - protein, 110 aa, Artificial Sequence
  Description of Artificial Sequence: Synthetic polypeptide
QSVLTQPPSVSGAPGQRVTISCAGSSSNIGAGFDVQWYQQLPGRAPKLLIFGNNNRPSGIPARFSGSKSGTSGSLAITGLQAEDEADYYCQSYDSRLSASVFGGGTKLTV

SEQ ID NO: 418 - protein, 11 aa, Artificial Sequence
  Description of Artificial Sequence: Synthetic peptide
QSYDSRLSASV

SEQ ID NO: 419 - protein, 127 aa, Artificial Sequence
  Description of Artificial Sequence: Synthetic polypeptide
EVQLLESGGGLLQPGGSLRLSCAASGFTFSSYVMSWVRQAPGKGLEWVSSISGSGGGTYYADSVKGRFTISRDNSKNTLFLQMNSLRAEDTAVYYCAKHPVMAALGDVYYYYGMDVWGQGTTVTVSS

SEQ ID NO: 420 - protein, 20 aa, Artificial Sequence
  Description of Artificial Sequence: Synthetic peptide
AKHPVMAALGDVYYYYGMDV

SEQ ID NO: 421 - protein, 111 aa, Artificial Sequence
  Description of Artificial Sequence: Synthetic polypeptide
QSVLTQPPSVSGAPGQRVTISCTGSSSNFGAGYDVHWYQLLPGTAPKLLMYGNSDRPSGVPDRFSGSKSGTSASLAITGLQAEDEADYYCQSYDSSLSGWVFGGGTKLTVL

SEQ ID NO: 422 - protein, 11 aa, Artificial Sequence
  Description of Artificial Sequence: Synthetic peptide
QSYDSSLSGWV

SEQ ID NO: 423 - protein, 122 aa, Artificial Sequence
  Description of Artificial Sequence: Synthetic polypeptide
QVQLVQSGAELKKPGASVRVSCKASGYTFTDYYIHWVRQAPGQGFEWMGWINPDSGGTNYPQNFQGRVTMTRGTSISTAYVELTRLRFDDTAVYYCARTSSPHSSSTGDLDYWGQGTLVTVS

SEQ ID NO: 424 - protein, 16 aa, Artificial Sequence
  Description of Artificial Sequence: Synthetic peptide
ARTSSPHSSSTGDLDY

SEQ ID NO: 425 - protein, 110 aa, Artificial Sequence
  Description of Artificial Sequence: Synthetic polypeptide
SYVLTQSPSVSVAPGKTARITCGGRDIGSKSVHWYQQRPGQAPVLVISYDNDRPSGIPERFSGSNSGNTATLTISRVEAGDEADYYCQVWDGTGDHPGWVFGGGTRLTVL

SEQ ID NO: 426 - protein, 13 aa, Artificial Sequence
  Description of Artificial Sequence: Synthetic peptide
QVWDGTGDHPGWV

SEQ ID NO: 427 - protein, 124 aa, Artificial Sequence
  Description of Artificial Sequence: Synthetic polypeptide
QVQLVQSGAEVKKPGSSVKVSCKASGGTFSSYAISWVRQAPGQGLEWMGGIVPIFGSANYAQKFQGRVTITADESTSTANMELRSLRFEDTAVYYCARGGYCVGGTCQDWFDPWGQGTLVIVSS

SEQ ID NO: 428 - protein, 17 aa, Artificial Sequence
  Description of Artificial Sequence: Synthetic peptide
ARGGYCVGGTCQDWFDP

SEQ ID NO: 429 - protein, 110 aa, Artificial Sequence
  Description of Artificial Sequence: Synthetic polypeptide
SYVLTQPPSVSVAPGKTARITCGGIDIGSKSVHWYQQKPGQAPLLVIYYDNDRPSGIPERLSGSNSGNTATLTISRVEAGDEADYYCQVWDGTSDHPAYVFGTGTKVSVL

SEQ ID NO: 430 - protein, 13 aa, Artificial Sequence
  Description of Artificial Sequence: Synthetic peptide
QVWDGTSDHPAYV

SEQ ID NO: 431 - protein, 125 aa, Artificial Sequence
  Description of Artificial Sequence: Synthetic polypeptide
QVQLVESGGGVVQPGRSLRLSCAASGFTFSNYDMHWVRQAPGKGLEWVAFISYDGGNKHSADSVKGRFSISRDNSKNTLYLQMNSLRPEDTAVYYCAHHQGGGTGVYYSDPFDSWGQGTLVTVSS

SEQ ID NO: 432 - protein, 18 aa, Artificial Sequence
  Description of Artificial Sequence: Synthetic peptide
AHHQGGGTGVYYSDPFDS

SEQ ID NO: 433 - protein, 105 aa, Artificial Sequence
  Description of Artificial Sequence: Synthetic polypeptide
SYVLTQPPSVSVAPGKTATITCGGDSVGSKSVHWYQQKSGQAPVLVISYDNDRPSGIPDRFSGSNSGNTATLTISRVEAGDEADYHCQVWDISPVFGGGTKLTVL

SEQ ID NO: 434 - protein, 8 aa, Artificial Sequence
  Description of Artificial Sequence: Synthetic peptide
QVWDISPV

SEQ ID NO: 435 - protein, 123 aa, Artificial Sequence
  Description of Artificial Sequence: Synthetic polypeptide
QVQLVQSGAEVKKPGASVKVSCKASGYTFSHYDINWVRQATGQGLEWMGWMNPNSGNTGYAQKFQGRVTLTKNTSISTVYMELRSLTSEDTAVYYCARGLSILAVSEDWFDPWGPGTLVTVSS

SEQ ID NO: 436 - protein, 16 aa, Artificial Sequence
  Description of Artificial Sequence: Synthetic peptide
ARGLSILAVSEDWFDP

SEQ ID NO: 437 - protein, 107 aa, Artificial Sequence
  Description of Artificial Sequence: Synthetic polypeptide
SYVLTQPPSVSVAPGKTARITCGGNNIGGKRIYWYQQKPGQAPVLVIYYNNDRPSGIPERFSGSNSGNTATLTISRVEAGDEADYYCQVWDNSIDHYIFGTGTKVTV

SEQ ID NO: 438 - protein, 11 aa, Artificial Sequence
  Description of Artificial Sequence: Synthetic peptide
QVWDNSIDHYI

SEQ ID NO: 439 - protein, 116 aa, Artificial Sequence
  Description of Artificial Sequence: Synthetic polypeptide
EVQLLESGGALVQPGGSLRLSCAASGFTFSIFAMSWVRQAPGKGLEWVSTISDVSTYYADSVKGRFTISRDNSKNTLYLQMNGLRAEDTAVYYCAKTIDTFFFDHWGQGTLVTVSS

SEQ ID NO: 440 - protein, 11 aa, Artificial Sequence
  Description of Artificial Sequence: Synthetic peptide
AKTIDTFFFDH

SEQ ID NO: 441 - protein, 108 aa, Artificial Sequence
  Description of Artificial Sequence: Synthetic polypeptide
SYVLTQPPSVSVAPGKTARITCGGNNIGSKSVYWYQQKPGQAPVLVIYYDSDRPSGIPERFSGSNSGNTATLTISGVEAGDEADYYCQVWDSSSDHWVFGGGTKLTVL

SEQ ID NO: 442 - protein, 11 aa, Artificial Sequence
  Description of Artificial Sequence: Synthetic peptide
QVWDSSSDHWV

SEQ ID NO: 443 - protein, 128 aa, Artificial Sequence; identical to SEQ ID NO: 223
  Description of Artificial Sequence: Synthetic polypeptide

SEQ ID NO: 444 - protein, 21 aa, Artificial Sequence
  Description of Artificial Sequence: Synthetic peptide
AREAHDGALTDYGDYLNWFDP

SEQ ID NO: 445 - protein, 110 aa, Artificial Sequence
  Description of Artificial Sequence: Synthetic polypeptide
SYVLTQPPSVSVAPGKTARITCGGTNIGSKNVHWYQQKPGQAPVLVIYYDNDRPSGIPERFSGSNSGNTATLTISRVEAGDEADYYCQVWDTTSDHFYWVFGGGTKLTVL

SEQ ID NO: 446 - protein, 13 aa, Artificial Sequence
  Description of Artificial Sequence: Synthetic peptide
QVWDTTSDHFYWV

SEQ ID NO: 447 - protein, 124 aa, Artificial Sequence
  Description of Artificial Sequence: Synthetic polypeptide
QVQLVQSGAEVKKPGASVRVSCKASGYTFTTYDINWVRQASGQGLEWMGWMNPDSGNTGYAQKFQGRVTMTRNISISTAYLDLSSLQSDDTAVYYCARDYGSGSYYRGNWFDPWGQGTLVIVSS

SEQ ID NO: 448 - protein, 17 aa, Artificial Sequence
  Description of Artificial Sequence: Synthetic peptide
ARDYGSGSYYRGNWFDP

SEQ ID NO: 449 - protein, 110 aa, Artificial Sequence
  Description of Artificial Sequence: Synthetic polypeptide
QSALTQPPSASGSPGQSVTISCTGTSSDVGGYNYVSWYQQHPGKAPKLMIYEVSKRPSGVPDRFSGSKSGNTASLTVSGLQAEDEAEYYCSSDAGSNNVVFGGGTKLTVL

SEQ ID NO: 450 - protein, 10 aa, Artificial Sequence
  Description of Artificial Sequence: Synthetic peptide
SSDAGSNNVV

SEQ ID NO: 451 - protein, 122 aa, Artificial Sequence
  Description of Artificial Sequence: Synthetic polypeptide
QVQLVQSGAEVRKPGASVKVSCMASGYTFNTYDINWVRQGTGQGLEWMGWMNPNSGNTGHAQKFQGRVAMTVNTSMNTAYMELSSLRSEDTAVYYCARGADMLNVAVGADFDYWGQGTLVTV

SEQ ID NO: 452 - protein, 17 aa, Artificial Sequence
  Description of Artificial Sequence: Synthetic peptide
ARGADMLNVAVGADFDY

SEQ ID NO: 453 - protein, 110 aa, Artificial Sequence
  Description of Artificial Sequence: Synthetic polypeptide
QSVLTQPPSASGSPGQSVTISCTGTSSDVGGYNFVSWFQQHPGKAPKLMIYEVSKRPSGVPDRFSGSKSANTASLTVSGLQAEDEADYFCSSYAGSNNWVFGGGTKLTVL

SEQ ID NO: 454 - protein, 10 aa, Artificial Sequence
  Description of Artificial Sequence: Synthetic peptide
SSYAGSNNWV

SEQ ID NO: 455 - protein, 126 aa, Artificial Sequence
  Description of Artificial Sequence: Synthetic polypeptide
QVQLVESGGGVVQPGRSLRLSCVGSGFTFSNYAVHWVRQAPGKGLEWVTVISSDGGDKDYADAVKGRFTISRDNSKYKVYLEMKSLRGEDTAVYYCAREGSSGSYYTGFYSYMDVWGKGTTVTVSS

SEQ ID NO: 456 - protein, 19 aa, Artificial Sequence
  Description of Artificial Sequence: Synthetic peptide
AREGSSGSYYTGFYSYMDV

SEQ ID NO: 457 - protein, 113 aa, Artificial Sequence
  Description of Artificial Sequence: Synthetic polypeptide
QSVLTQPASVSGSPGQSITISCTGTSSDVGNYNYVSWYQQHPGKAPKVMIYDVDTRPSGVSDRFSGSKSGNTASLTISGLQPEDEADYYCSSYTSNSALANWVFGGGTKLTVL

SEQ ID NO: 458 - protein, 13 aa, Artificial Sequence
  Description of Artificial Sequence: Synthetic peptide
SSYTSNSALANWV

SEQ ID NO: 459 - protein, 126 aa, Artificial Sequence
  Description of Artificial Sequence: Synthetic polypeptide
QVQLVQSGAEVKKPGASVKVSCKASGYTFTDHYMHWVRQAPGQGLEWMGWINPNTGGTNFAQKFQGRVTMTRDTSISTAYMELNRLRSDDTAVYYCARVGRLAPRPYYFYYYMDVWGKGTTVTVSS

SEQ ID NO: 460 - protein, 19 aa, Artificial Sequence
  Description of Artificial Sequence: Synthetic peptide
ARVGRLAPRPYYFYYYMDV

SEQ ID NO: 461 - protein, 110 aa, Artificial Sequence
  Description of Artificial Sequence: Synthetic polypeptide
QSVLTQPASVSGSPGQSITISCTGTSSDVGDYNYVSWYQQYPGKAPKLMIYDVSNRPSGVSDRFSGSKSGNTASLTISGLQAEDEADYYCSSYTSTTTLVFGTGTKVTVL

SEQ ID NO: 462 - protein, 10 aa, Artificial Sequence
  Description of Artificial Sequence: Synthetic peptide
SSYTSTTTLV

SEQ ID NO: 463 - protein, 121 aa, Artificial Sequence
  Description of Artificial Sequence: Synthetic polypeptide
QVQLQESGPGLVKPSQTLSLTCTVSGGSISSGDYYWSWVRQPPGKGLEWIGYIYYTGITYYRPSLKSRVTISVDTSKNQFSLKLSSVTAADTAVFYCARVVRLWPRYFDSWGQGTLVTVSS

SEQ ID NO: 464 - protein, 13 aa, Artificial Sequence
  Description of Artificial Sequence: Synthetic peptide
ARVVRLWPRYFDS

SEQ ID NO: 465 - protein, 110 aa, Artificial Sequence
  Description of Artificial Sequence: Synthetic polypeptide
QSVLTQPPSASGSPGQSVTISCTGTSSDVGTYDYVSWYQQHPGKAPKVIIYEVSRRPSGVPDRFSGSKSGNTASLTVSGLQAEDEAHYYCSTYAGSDNLEFGGGTKLTVL

SEQ ID NO: 466 - protein, 10 aa, Artificial Sequence
  Description of Artificial Sequence: Synthetic peptide
STYAGSDNLE

SEQ ID NO: 467 - protein, 123 aa, Artificial Sequence
  Description of Artificial Sequence: Synthetic polypeptide
QVQLVQSGAEVKKPGSSVKVSCKASGGTFNSYALSWVRQAPGQGLEWMGGIIFIFDKPDYAQKFKGRLTITADESTNTVYMELSSLRSEDTAVYYCAREGGHTHPYYHGMDVWGQGTTVTVYS

SEQ ID NO: 468 - protein, 16 aa, Artificial Sequence
  Description of Artificial Sequence: Synthetic peptide
AREGGHTHPYYHGMDV

SEQ ID NO: 469 - protein, 109 aa, Artificial Sequence
  Description of Artificial Sequence: Synthetic polypeptide
QSVLTQPPSASGSPGQSVTISCTGTSSDVGGYNYVSWYQQHPGKAPKLMIYEVTKRPSGVPDRFSGSKSGNTASLTVSGLRPEDEADYYCTSYAGSITYVFGTGTKVSV

SEQ ID NO: 470 - protein, 10 aa, Artificial Sequence
  Description of Artificial Sequence: Synthetic peptide
TSYAGSITYV

SEQ ID NO: 471 - protein, 124 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSMGYAESLKGRFTISRDNAKNSLYLQMNSLRAEDTALYYCAKPKKRGDYYGSGSFDYWGQGTLVTVSS

SEQ ID NO: 472 - protein, 17 aa, Artificial Sequence
  Description of Artificial Sequence: Synthetic peptide
AKPKKRGDYYGSGSFDY

SEQ ID NO: 473 - protein, 110 aa, Artificial Sequence
  Description of Artificial Sequence: Synthetic polypeptide
QSVLTQPASVSGSPGQSITISCTGTNSDIGAYNFVSWYQQHPGKAPKLMIYDVNNRPSGVSSRFSGSKSGNTASLTISGLQAEDEADYYCTSYRMTSTVVFGGGTKLTVL

SEQ ID NO: 474 - protein, 10 aa, Artificial Sequence
  Description of Artificial Sequence: Synthetic peptide
TSYRMTSTVV

SEQ ID NO: 475 - protein, 123 aa, Artificial Sequence
  Description of Artificial Sequence: Synthetic polypeptide
QLQLQESGPGLVKPSETLSLTCIVSGGSINSTTYYWDWIRQSPGKGLEWIGSIFYTGITYYSPSLKTRVTISVDTSKNQFSLRLNSMTAADTAVYYCARRLRQLWFGPWFDPWGQGTLVTVSS

SEQ ID NO: 476 - protein, 15 aa, Artificial Sequence
  Description of Artificial Sequence: Synthetic peptide
ARRLRQLWFGPWFDP

SEQ ID NO: 477 - protein, 110 aa, Artificial Sequence
  Description of Artificial Sequence: Synthetic polypeptide
QSVLTQPPSASGSPGQSVTISCTGTRSDVGDYNYVSWYQQHPDKAPKLIIFEVTKRPSGVPDRFSGSKSGNTASLTVSGLQAEDEADYYCSSYAGSSNVMFGGGTKLTVL

SEQ ID NO: 478 - protein, 10 aa, Artificial Sequence
  Description of Artificial Sequence: Synthetic peptide
SSYAGSSNVM

SEQ ID NO: 479 - protein, 123 aa, Artificial Sequence
  Description of Artificial Sequence: Synthetic polypeptide
QLQLQESGPGLVKPSETLSLTCTVSGGSISSTTYYWDWIRQSPGKGLEWIGSIFYTGITYYSPSLKSRVTISVDTSKNQFSLRLNSMTAADTAVYYCARRLRQLWFGPWFDPWGQGTLVTVSS

SEQ ID NO: 480 - protein, 15 aa, Artificial Sequence
  Description of Artificial Sequence: Synthetic peptide
ARRLRQLWFGPWFDP

SEQ ID NO: 481 - protein, 110 aa, Artificial Sequence
  Description of Artificial Sequence: Synthetic polypeptide
QSVLTQPPSASGSPGQSVTISCTGTRSDVGDYNYVSWYQQHPDKAPKLIIYEVTKRPSGVPDRFSGSKSGNTASLTVSGLQAEDEADYYCSSYAGSNNVMFGGGTKLTVL

SEQ ID NO: 482 - protein, 10 aa, Artificial Sequence
  Description of Artificial Sequence: Synthetic peptide
SSYAGSNNVM

SEQ ID NO: 483 - protein, 120 aa, Artificial Sequence; identical to SEQ ID NO: 239
  Description of Artificial Sequence: Synthetic polypeptide

SEQ ID NO: 484 - protein, 11 aa, Artificial Sequence
  Description of Artificial Sequence: Synthetic peptide
TTDHGREPPVH

SEQ ID NO: 485 - protein, 107 aa, Artificial Sequence; identical to SEQ ID NO: 240
  Description of Artificial Sequence: Synthetic polypeptide

SEQ ID NO: 486 - protein, 8 aa, Artificial Sequence
  Description of Artificial Sequence: Synthetic peptide
LQYGPSPT

SEQ ID NO: 487 - protein, 120 aa, Artificial Sequence
  Description of Artificial Sequence: Synthetic polypeptide
EVQLVQSGAEVKKPGESLKISCKGSGFLFSRYWIGWVRQMPGKGLEWLGIIYSGDSDTRYSPSFQGQVTFSVDKSVNTAYLHWSSLKASDTAVYYCARTQHGVTDAFDIWGQGTMVTVSP

SEQ ID NO: 488 - protein, 13 aa, Artificial Sequence
  Description of Artificial Sequence: Synthetic peptide
ARTQHGVTDAFDI

SEQ ID NO: 489 - protein, 106 aa, Artificial Sequence
  Description of Artificial Sequence: Synthetic polypeptide
DIQMTQSPSTLSASVGDRVTITCRASQSISSWLAWYQQKPGKAPKFLIYEASRLESGVPSRFSGSGSGTEFTLTINSLQPDDFATYYCQQYSNYSPTFGQGTKVEF

SEQ ID NO: 490 - protein, 9 aa, Artificial Sequence
  Description of Artificial Sequence: Synthetic peptide
QQYSNYSPT

SEQ ID NO: 491 - protein, 123 aa, Artificial Sequence; identical to SEQ ID NO: 213
  Description of Artificial Sequence: Synthetic polypeptide

SEQ ID NO: 492 - protein, 15 aa, Artificial Sequence
  Description of Artificial Sequence: Synthetic peptide
ARVWQYYDSTGSFDY

SEQ ID NO: 493 - protein, 112 aa, Artificial Sequence; identical to SEQ ID NO: 214
  Description of Artificial Sequence: Synthetic polypeptide

SEQ ID NO: 494 - protein, 9 aa, Artificial Sequence
  Description of Artificial Sequence: Synthetic peptide
MQALQTPFT

SEQ ID NO: 495 - protein, 122 aa, Artificial Sequence
  Description of Artificial Sequence: Synthetic polypeptide
QVQLVESGGGVVQPGRSLRLACAASGFTFSSYGMHWVRRAPGKGLEWVAVIWHDGSNKYYADSVKGRFTISRDNSKSTLFLQMNSLRAEDTAVYYCARGDTSGWYALGLDVWGRGTTVTVSS

SEQ ID NO: 496 - protein, 15 aa, Artificial Sequence
  Description of Artificial Sequence: Synthetic peptide
ARGDTSGWYALGLDV

SEQ ID NO: 497 - protein, 109 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPYTFGQGTKLEIK

SEQ ID NO: 498 - protein, 10 aa, Artificial Sequence
  Description of Artificial Sequence: Synthetic peptide
QQYGSSPPYT

SEQ ID NO: 499 - protein, 126 aa, Artificial Sequence; identical to SEQ ID NO: 225
  Description of Artificial Sequence: Synthetic polypeptide

SEQ ID NO: 500 - protein, 19 aa, Artificial Sequence
  Description of Artificial Sequence: Synthetic peptide
AKAGVRGIAAAGPDLNFDY

SEQ ID NO: 501 - protein, 103 aa, Artificial Sequence; identical to SEQ ID NO: 226
  Description of Artificial Sequence: Synthetic polypeptide

SEQ ID NO: 502 - protein, 5 aa, Artificial Sequence
  Description of Artificial Sequence: Synthetic peptide
QQRIT

SEQ ID NO: 503 - protein, 126 aa, Artificial Sequence
  Description of Artificial Sequence: Synthetic polypeptide
QVQLVESGGGVVQPGRSLRLSCAASGFTFSSFAMHWVRQAPGKGLEWVAVISYDGSNKYYADSVQGRFTISRDNSKNTLSLQMNSLRAEDTAVYYCAKQLVSGGYGDLWFGGLDYWGQGTLVTVSS

SEQ ID NO: 504 - protein, 19 aa, Artificial Sequence
  Description of Artificial Sequence: Synthetic peptide
AKQLVSGGYGDLWFGGLDY

SEQ ID NO: 505 - protein, 107 aa, Artificial Sequence
  Description of Artificial Sequence: Synthetic polypeptide
EIVLTQSPATLSLSPGERATLSCRASQSVSSFLAWYQQKPGQAPRLLIHDASDRATGIPARFSGSGSGTDFTLTISSLEPEDFAVYYCQQRSNWPQTFGQGTKVEIK

SEQ ID NO: 506 - protein, 9 aa, Artificial Sequence
  Description of Artificial Sequence: Synthetic peptide
QQRSNWPQT

SEQ ID NO: 507 - protein, 122 aa, Artificial Sequence
  Description of Artificial Sequence: Synthetic polypeptide
QVQLVESGGGVVRPGRSLRLSCAASGFTFNNYGMHWVRQAPGKGLEWVAVIGSDGHIKHYADSVKGRFTISRDNSKNTLYLQLNSLRAEDTAMYYCARDQSLEEFLVTWFDPWGQGTLVTVS

SEQ ID NO: 508 - protein, 16 aa, Artificial Sequence
  Description of Artificial Sequence: Synthetic peptide
ARDQSLEEFLVTWFDP

SEQ ID NO: 509 - protein, 108 aa, Artificial Sequence
  Description of Artificial Sequence: Synthetic polypeptide
DIQMTQSPSSLSASVGDRVTITCRASQSISSYLNWYQQKPGKAPKLLIHAASSLQSGVPSRFSGSGSGTDFTLTINSLQPEDFATYYCQQSYNTPPWTFGQGTKVEIK

SEQ ID NO: 510 - protein, 10 aa, Artificial Sequence
  Description of Artificial Sequence: Synthetic peptide
QQSYNTPPWT

SEQ ID NO: 511 - protein, 123 aa, Artificial Sequence
  Description of Artificial Sequence: Synthetic polypeptide
QVQLVESGGGLVKPGGSLRLSCAVSGFTFSEYYMSWIRQAPEKGLEWVSHISSSGSTMYYADSVKGRFTISRDNAKNSLYLQMNSLRAEDTAVYYCATDRTKNSYDSSGGDYWGQGTLVTVSS

SEQ ID NO: 512 - protein, 16 aa, Artificial Sequence
  Description of Artificial Sequence: Synthetic peptide
ATDRTKNSYDSSGGDY

SEQ ID NO: 513 - protein, 113 aa, Artificial Sequence
  Description of Artificial Sequence: Synthetic polypeptide
DVVMTQSPLSLPVTLGQPASISCRSSESLVYSDGNTYLSWFQQRPGQSPRRLIYKVSNRDSGVPDRFSGSGSGTDFTLKISRVEAEDVGVYYCMQGTHWPPYTFGQGTKLEIK

SEQ ID NO: 514 - protein, 10 aa, Artificial Sequence
  Description of Artificial Sequence: Synthetic peptide
MQGTHWPPYT

SEQ ID NO: 515 - protein, 123 aa, Artificial Sequence
  Description of Artificial Sequence: Synthetic polypeptide
QMQLVQSGPEVKKPGTSVKVSCKASGFTFYNSAVQWVRQARGQRLEWVGWIVVGSGNTDYAQKFQERVTMTRDLSTNTAYMEVNSLRSEDTAVYYCAAPYCSGGTCLDGFDIWGQGTMVTVSS

SEQ ID NO: 516 - protein, 16 aa, Artificial Sequence
  Description of Artificial Sequence: Synthetic peptide
AAPYCSGGTCLDGFDI

SEQ ID NO: 517 - protein, 108 aa, Artificial Sequence; identical to SEQ ID NO: 220
  Description of Artificial Sequence: Synthetic polypeptide

SEQ ID NO: 518 - protein, 9 aa, Artificial Sequence
  Description of Artificial Sequence: Synthetic peptide
QQYGSSPWT

SEQ ID NO: 519 - protein, 118 aa, Artificial Sequence; identical to SEQ ID NO: 217
  Description of Artificial Sequence: Synthetic polypeptide

SEQ ID NO: 520 - protein, 12 aa, Artificial Sequence
  Description of Artificial Sequence: Synthetic peptide
ARDLYSSGGTDI

SEQ ID NO: 521 - protein, 108 aa, Artificial Sequence; identical to SEQ ID NO: 218
  Description of Artificial Sequence: Synthetic polypeptide

SEQ ID NO: 522 - protein, 9 aa, Artificial Sequence
  Description of Artificial Sequence: Synthetic peptide
QQYGSSPGT

SEQ ID NO: 523 - protein, 115 aa, Artificial Sequence
  Description of Artificial Sequence: Synthetic polypeptide
EVQLVESGGGLIQPGGSLRVSCAASGVTVSSNYMTWVRQGPGKGLEWVSVIYPGGNTFYADSVKGRFTISRDTSKNTLSLQMNSLRVEDTAVYYCARDLGERGMDVWGHGTTVTV

SEQ ID NO: 524 - protein, 11 aa, Artificial Sequence
  Description of Artificial Sequence: Synthetic peptide
ARDLGERGMDV

SEQ ID NO: 525 - protein, 106 aa, Artificial Sequence
  Description of Artificial Sequence: Synthetic polypeptide
DIQMTQSPSSVSASVGDRVTITCRASQGFGNWLAWYQQKPGKAPKLLIYAASNLQSGVPSRFSGSGSGTDFTLTISSLQAEDFATYFCQQANSFPSFGGGTKVEIK

SEQ ID NO: 526 - protein, 8 aa, Artificial Sequence
  Description of Artificial Sequence: Synthetic peptide
QQANSFPS

SEQ ID NO: 527 - protein, 120 aa, Artificial Sequence
  Description of Artificial Sequence: Synthetic polypeptide
QVQLVESGGGVVQPGRSLRLSCAASGFTFNNYGMHWVRQAPGKGLEWVAVIWYDGRSKHYADSVRGRFTISRDNSKNALFLQMNTLRAEDTAMYYCARDEGSLTTTFDSWGQGTLVTVSS

SEQ ID NO: 528 - protein, 13 aa, Artificial Sequence
  Description of Artificial Sequence: Synthetic peptide
ARDEGSLTTTFDS

SEQ ID NO: 529 - protein, 107 aa, Artificial Sequence
  Description of Artificial Sequence: Synthetic polypeptide
DIQMTQSPSSLSASVGDRVTITCRASQSISSHLNWFQQKPGKAPKLLIYAASSLQTGVPSRFSGSGSGTDFTLTITSLQPEDFATYYCQQSYATPPWTFGQGTKVEI

SEQ ID NO: 530 - protein, 10 aa, Artificial Sequence
  Description of Artificial Sequence: Synthetic peptide
QQSYATPPWT

SEQ ID NO: 531 - protein, 122 aa, Artificial Sequence
  Description of Artificial Sequence: Synthetic polypeptide
EVQLLESGGGLVQPGGSLRLSCAASGFTFSSYVMSWVRQAPGKGLEWVSEISGSGDITDYADSVKGRFTISRDNSKKTLYLQMKSLRAEDTAVYYCARDSQLIDMVVVLDYWGQGTLVTVSS

SEQ ID NO: 532 - protein, 15 aa, Artificial Sequence
  Description of Artificial Sequence: Synthetic peptide
ARDSQLIDMVVVLDY

SEQ ID NO: 533 - protein, 104 aa, Artificial Sequence
  Description of Artificial Sequence: Synthetic polypeptide
  MOD_RES (50)..(50): Any amino acid
DIQMTQSPSSLSASVGDRVTITCRTSQTISNYLNWFQQKPGKAPKLLIYXVSSLRSGVPSRFSGSGSGTDFTLTISSLQPEDFATYYCQQTYTTPPTFGGGTKV

SEQ ID NO: 534 - protein, 9 aa, Artificial Sequence
  Description of Artificial Sequence: Synthetic peptide
QQTYTTPPT

SEQ ID NO: 535 - protein, 121 aa, Artificial Sequence
  Description of Artificial Sequence: Synthetic polypeptide
QVQLVESGGGVVQPGRSLRLSCAATGFTFSNFGMHWVRQAPGKGLEWVAVISYHGTNKDYADSVKGRFTISRDNSKNTLYLQLNSLRFDDTAVYYCARALDGDYSEYFQHWGQGTLVTVSS

SEQ ID NO: 536 - protein, 14 aa, Artificial Sequence
  Description of Artificial Sequence: Synthetic peptide
ARALDGDYSEYFQH

SEQ ID NO: 537 - protein, 112 aa, Artificial Sequence
  Description of Artificial Sequence: Synthetic polypeptide
DVVMTQSPLSLPVTLGQPASISCTSSQSLLFSDGNTYLTWFQQRPGQSPRRLIYKVSNRDSGVPDRFSGSGSGTDFTLKISRVEAEDVGVYYCMQSTHWPQTFGQGTKVEIK

SEQ ID NO: 538 - protein, 9 aa, Artificial Sequence
  Description of Artificial Sequence: Synthetic peptide
MQSTHWPQT

SEQ ID NO: 539 - protein, 122 aa, Artificial Sequence
  Description of Artificial Sequence: Synthetic polypeptide
EVQLVESGGGLVQPDRSLRLSCAASGFTFDDYAMHWVRQAPGKGLEWVSGISRNSGIKVYADSVKGRFTISRDNAKNSLFLQMNSLRAEDTALYYCVKEIGLELPVDVFDFWGQGTMVTVSS

SEQ ID NO: 540 - protein, 15 aa, Artificial Sequence
  Description of Artificial Sequence: Synthetic peptide
VKEIGLELPVDVFDF

SEQ ID NO: 541 - protein, 107 aa, Artificial Sequence
  Description of Artificial Sequence: Synthetic polypeptide
DIQMTQSPSSLSASVGDRVTLTCRASQSISRYLNWFQQKAGKAPKLLIYAASSLQTGVPSRFSGSGSGTDFTLTISSLQLEDFATYYCQQSYSTPVTFGQGTRLEIK

SEQ ID NO: 542 - protein, 9 aa, Artificial Sequence
  Description of Artificial Sequence: Synthetic peptide
QQSYSTPVT

SEQ ID NO: 543 - protein, 120 aa, Artificial Sequence
  Description of Artificial Sequence: Synthetic polypeptide
EVQLVESGGGLVQPGGSLRLSCAASGFTFSTYDMHWVRQATGKGLEWVSAIGTSGDTYYPDSVKGRFTISRENAKNSLFLQMNGLRAGDTAIYYCARGNWNPPSYYYMDVWGKGTTVTVS

SEQ ID NO: 544 - protein, 15 aa, Artificial Sequence
  Description of Artificial Sequence: Synthetic peptide
ARGNWNPPSYYYMDV

SEQ ID NO: 545 - protein, 108 aa, Artificial Sequence
  Description of Artificial Sequence: Synthetic polypeptide
DIQMTQSPSSLSASVGDRVTISCRASQSINTYLNWYQQRPGKAPKLLIYASSSLQSGVPSRFSGSGSGTDFTLTISSLQPEDFATYYCQQSYSTPPWTFSQGTKVEIK

SEQ ID NO: 546 - protein, 10 aa, Artificial Sequence
  Description of Artificial Sequence: Synthetic peptide
QQSYSTPPWT

SEQ ID NO: 547 - protein, 124 aa, Artificial Sequence
  Description of Artificial Sequence: Synthetic polypeptide
QVQLVESGGGVVQPGRSLRLSCVASGFSFSKYGMHWVRQAPGKGLEWVAVVSYDGSNKYYADSVKGRIAVSRDNSKNTLFLQMNSLKAEDTAVYYCAKGGLYGSGTYYENFDYWGQGTRVTVSS

SEQ ID NO: 548 - protein, 17 aa, Artificial Sequence
  Description of Artificial Sequence: Synthetic peptide
AKGGLYGSGTYYENFDY

SEQ ID NO: 549 - protein, 107 aa, Artificial Sequence
  Description of Artificial Sequence: Synthetic polypeptide
DIQMTQSPSSLSASVGDRVTIICQASQDITYYLNWFQQKPGKPPKLLIHDASNLEAGVPSRFSGGGSGTDFTFTISSLQPEDFATYYCQQYEHLPYTFGQGTRLEIK

SEQ ID NO: 550 - protein, 9 aa, Artificial Sequence
  Description of Artificial Sequence: Synthetic peptide
QQYEHLPYT

SEQ ID NO: 551 - protein, 124 aa, Artificial Sequence
  Description of Artificial Sequence: Synthetic polypeptide
QVQLVESGGGVVQPGRSLRLSCAASGLAFSIYGMHWVRQAPGKGLEWVAIVAQDGSKKYYADSVKGRFTISRDNSKNTLYLEMNSLRTEDTAVYYCVKEGRPSDTVVVVAFDYWGQGSLVTVSS

SEQ ID NO: 552 - protein, 17 aa, Artificial Sequence
  Description of Artificial Sequence: Synthetic peptide
VKEGRPSDTVVVVAFDY

SEQ ID NO: 553 - protein, 107 aa, Artificial Sequence
  Description of Artificial Sequence: Synthetic polypeptide
DIQMTQSPSSLSASVGDRVTITCRASQSISNYLNWYQQKPGKAPKVIIYAASSLQSGVPSRFSGSGSGTDFTLTISSLQPEDFATYYCQQSHSIPRTFGQGTKVEIK

SEQ ID NO: 554 - protein, 9 aa, Artificial Sequence
  Description of Artificial Sequence: Synthetic peptide
QQSHSIPRT

SEQ ID NO: 555 - protein, 128 aa, Artificial Sequence; identical to SEQ ID NO: 231
  Description of Artificial Sequence: Synthetic polypeptide

SEQ ID NO: 556 - protein, 20 aa, Artificial Sequence
  Description of Artificial Sequence: Synthetic peptide
ARESFYYDRSGYYGSDAFDI

SEQ ID NO: 557 - protein, 107 aa, Artificial Sequence
  Description of Artificial Sequence: Synthetic polypeptide
DIQMTQSPSTLSSSVGDRVTITCRASQNISRWLAWYQQKPGKAPKLLIYKASTLESGVPSRFSGSGSGTKFTLTISSLQPDDFATYYCQQYNSYLYTFGQGTKLEMK

SEQ ID NO: 558 - protein, 9 aa, Artificial Sequence
  Description of Artificial Sequence: Synthetic peptide
QQYNSYLYT

SEQ ID NO: 559 - protein, 116 aa, Artificial Sequence
  Description of Artificial Sequence: Synthetic polypeptide
EVQLVESGGGLIHPGGSLRLSCAASDIIVSSNYMSWVRQAPGKGLEWVSVIYPGGSAFYGDSVKGRFTVSRDNSKNTLYLQMNSLSAEDTAVYYCARDLVVNGMDVWGQGTTVIVS

SEQ ID NO: 560 - protein, 11 aa, Artificial Sequence
  Description of Artificial Sequence: Synthetic peptide
ARDLVVNGMDV

SEQ ID NO: 561 - protein, 106 aa, Artificial Sequence
  Description of Artificial Sequence: Synthetic polypeptide
DIQLTQSPSFLSASVGDRVTITCRASQGISNYLAWYQQKPGKAPKLLIYAASTLQSGVPSRFSGSGSGTEFTLTISGLQPEDFATYYCQLLNSDPYTFGQGTKLEI

SEQ ID NO: 562 - protein, 9 aa, Artificial Sequence
  Description of Artificial Sequence: Synthetic peptide
QLLNSDPYT

SEQ ID NO: 563 - protein, 123 aa, Artificial Sequence
  Description of Artificial Sequence: Synthetic polypeptide
QVQLQESGPGLVKPSQTLSLTCTVSGGSISSGGYYWNWIRQHPGRGLEWIGYIFYSGSTYYNASLRSRVTISIDTSKNQFSLKLKSVTAADTAVYYCARDQGYSSSWDAFDIWGQGTMVTVSS

SEQ ID NO: 564 - protein, 15 aa, Artificial Sequence
  Description of Artificial Sequence: Synthetic peptide
ARDQGYSSSWDAFDI

SEQ ID NO: 565 - protein, 107 aa, Artificial Sequence
  Description of Artificial Sequence: Synthetic polypeptide
EIVLTQSPGTLSLSPGERATLSCRASQSISSSYVAWYQQKTGQAPRLLIYGASSRATGIPDRFSGSGSGTEFTLTISRLEPEDFAVYYCQQHGSSLTFGGGTKVEIK

SEQ ID NO: 566 - protein, 8 aa, Artificial Sequence
  Description of Artificial Sequence: Synthetic peptide
QQHGSSLT

SEQ ID NO: 567 - protein, 126 aa, Artificial Sequence
  Description of Artificial Sequence: Synthetic polypeptide
QVQLVQSGAEVKKPGASVKVSCKASGYTFTSYGINWVRQAPGQGLEWMGWISAFNGDTNYAQKVQGRVTMTTDTSTNTVYMELRSLRSDDTAVYYCARDEYYYESGASSADIGHIWGQGTVVTVSS

SEQ ID NO: 568 - protein, 19 aa, Artificial Sequence
  Description of Artificial Sequence: Synthetic peptide
ARDEYYYESGASSADIGHI

SEQ ID NO: 569 - protein, 109 aa, Artificial Sequence
  Description of Artificial Sequence: Synthetic polypeptide
DIQMTQSPSSLSASVGDRVTITCRASQGIRNHLGWFQQKPGEAPKRLIYAASSLQTGVPSRFSGSGSGTQFTLTIASLQPEDFATYYCLHHDDFPPRFTFGPGTKVNVK

SEQ ID NO: 570 - protein, 11 aa, Artificial Sequence
  Description of Artificial Sequence: Synthetic peptide
LHHDDFPPRFT

SEQ ID NO: 571 - protein, 126 aa, Artificial Sequence; identical to SEQ ID NO: 211
  Description of Artificial Sequence: Synthetic polypeptide

SEQ ID NO: 572 - protein, 17 aa, Artificial Sequence
  Description of Artificial Sequence: Synthetic peptide
TTGPQYDDFGHSYIVDS

SEQ ID NO: 573 - protein, 112 aa, Artificial Sequence; identical to SEQ ID NO: 212
  Description of Artificial Sequence: Synthetic polypeptide

SEQ ID NO: 574 - protein, 9 aa, Artificial Sequence
  Description of Artificial Sequence: Synthetic peptide
MQTLQTPLT

SEQ ID NO: 575 - protein, 123 aa, Artificial Sequence
  Description of Artificial Sequence: Synthetic polypeptide
EVQLVESGGGLVKPGGSLRLSCAASGFTFSNAWMSWVRQAPGRGLEWVGRIKSKTDGGTTDYAAPVKGRFTISRDDSKNTLYLQMNSLKTEDTAVYYCTTDDPGSYYYGMDVWGQGTTVTVSS

SEQ ID NO: 576 - protein, 14 aa, Artificial Sequence
  Description of Artificial Sequence: Synthetic peptide
TTDDPGSYYYGMDV

SEQ ID NO: 577 - protein, 105 aa, Artificial Sequence
  Description of Artificial Sequence: Synthetic polypeptide
DIQMTQSPSSLSASVGDRVTITCQASQDISNYLNWYQQKPGKVPKLLIYDASNLEAGVPSRFSGSGSGKDFTFTISSLQPEDIATYYCQQYDSFPITFGPGTKVD

SEQ ID NO: 578 - protein, 9 aa, Artificial Sequence
  Description of Artificial Sequence: Synthetic peptide
QQYDSFPIT

SEQ ID NO: 579 - protein, 126 aa, Artificial Sequence
  Description of Artificial Sequence: Synthetic polypeptide
EVQLVESGGGLVQPGGSLRLSCAASGFTLSSHDMHWVRQVPGKRLEWVSAIGPSGDTYYPDSVKGRFTISRENAKNSLYLQMNSLRAGDTAVYYCARGNYFDSSGFRNYYYGMDVWGQGTTVTVSS

SEQ ID NO: 580 - protein, 20 aa, Artificial Sequence
  Description of Artificial Sequence: Synthetic peptide
ARGNYFDSSGFRNYYYGMDV

SEQ ID NO: 581 - protein, 108 aa, Artificial Sequence
  Description of Artificial Sequence: Synthetic polypeptide
EIVMTQSPATLSVSPGERATLSCRASQSVSSNLAWYQQKPGQAPRVLIYGASTRATGIPARFSGSGSGTEFTLTISSLQSEDFAVYYCQQYHNWPPLTFGGGTKVEIK

SEQ ID NO: 582 - protein, 10 aa, Artificial Sequence
  Description of Artificial Sequence: Synthetic peptide
QQYHNWPPLT

SEQ ID NO: 583 - protein, 118 aa, Artificial Sequence
  Description of Artificial Sequence: Synthetic polypeptide
QVQLVESGGGVVQPGRSLRLSCVASGFSFSNYGMHWVRQAPGKGLEWVAAIWYDGVDKYRDSVKGRFTISRDNSKNTLYLQMNSLRVEDTAVYYCARVFGNWDDFDYWGQGTLVTVSS

SEQ ID NO: 584 - protein, 12 aa, Artificial Sequence
  Description of Artificial Sequence: Synthetic peptide
ARVFGNWDDFDY

SEQ ID NO: 585 - protein, 107 aa, Artificial Sequence
  Description of Artificial Sequence: Synthetic polypeptide
DIQMTQSPSSLSASVGDRATITCRASQGITNDLGWYQQKPGKAPKRLIYGASSLQSGVPSRFSGSGSGTEFTLTISSLQPEDFATYYCLQHNSYPWTFGQGTKVEIK

SEQ ID NO: 586 - protein, 9 aa, Artificial Sequence
  Description of Artificial Sequence: Synthetic peptide
LQHNSYPWT

SEQ ID NO: 587 - protein, 123 aa, Artificial Sequence
  Description of Artificial Sequence: Synthetic polypeptide
EVQLVESGGGLVQPGRSLRLSCAASGFTLDDFAMHWVRQAPGKGLEWVSGISWNSGTIDYADSVKGRFTISRDNAKNSLYLQMNSLRPEDTAFYYCAKVLNRNSFFYGSFDYWGQGTLVTVSS

SEQ ID NO: 588 - protein, 16 aa, Artificial Sequence
  Description of Artificial Sequence: Synthetic peptide
AKVLNRNSFFYGSFDY

SEQ ID NO: 589 - protein, 109 aa, Artificial Sequence
  Description of Artificial Sequence: Synthetic polypeptide
EIVMTQSPATLSVSPGESVTLSCRASQSVSSNLAWYQQKPGQAPRLLIYGASTRATGVPARFSGSGSGTEFTLTISSLQSEDFAVYYCQHYNNWPPGITFGQGTRLEIK

SEQ ID NO: 590 - protein, 11 aa, Artificial Sequence
  Description of Artificial Sequence: Synthetic peptide
QHYNNWPPGIT

SEQ ID NO: 591 - protein, 125 aa, Artificial Sequence
  Description of Artificial Sequence: Synthetic polypeptide
QVQLVESGGGVVQPGRSLRLSCAASGFTFSRYGMHWVRQAPGKGLEWVAVSSYDGSNEYYANSVKGRFTISRDNSKNTLYLQMNSLRAEDTAVYYCAKTGASYCGGDCPFHFDYWGQGTLVIVSS

SEQ ID NO: 592 - protein, 18 aa, Artificial Sequence
  Description of Artificial Sequence: Synthetic peptide
AKTGASYCGGDCPFHFDY

SEQ ID NO: 593 - protein, 107 aa, Artificial Sequence
  Description of Artificial Sequence: Synthetic polypeptide
DIQMTQSPSSLSASVGDRVTITCQASQDINNYLNWYQQKPGKAPKLLIYDASDLETGVPSRFSGGGSGTDFTFTISSLQPEDIATYYCQHYNNLPITFGQGTRLEIK

SEQ ID NO: 594 - protein, 9 aa, Artificial Sequence
  Description of Artificial Sequence: Synthetic peptide
QHYNNLPIT

SEQ ID NO: 595 - protein, 130 aa, Artificial Sequence
  Description of Artificial Sequence: Synthetic polypeptide
EVQLVESGGGLIQPGGSLRLSCAASGFTFSTSDMHWVRQVIGKGLEWVSVIGSAGDTYYPDSVKGRFTISRENARNSLYLQMNSLRAEDTAVYYCARGRQQLIPDLITSRYNYYYYMDLWGKGTTVIVSS

SEQ ID NO: 596 - protein, 24 aa, Artificial Sequence
  Description of Artificial Sequence: Synthetic peptide
ARGRQQLIPDLITSRYNYYYYMDL

SEQ ID NO: 597 - protein, 108 aa, Artificial Sequence
  Description of Artificial Sequence: Synthetic polypeptide
DIQMTQSPSSLSASVGDRVTITCRASQSIGSYLNWYQQKPGKAPKLLIYAASSLQSGVPSRFSGSGSGTDFTLTISSLQPEDFATYYCQQSYSTLSYTFGQGTKLDIK

SEQ ID NO: 598 - protein, 10 aa, Artificial Sequence
  Description of Artificial Sequence: Synthetic peptide
QQSYSTLSYT

SEQ ID NO: 599 - protein, 127 aa, Artificial Sequence
  Description of Artificial Sequence: Synthetic polypeptide
EVQLVESGGGLIKPGGSLRLSCAASGFSFSDAWMTWVRQAPGKGLEWIGRIKSKTDGGTTDYAAPVKGRFTISRDDSKNTLYLQMKSLKTEDTAVYYCATAADIVVVVAPDSPFDCWGQGTLVTVSS

SEQ ID NO: 600 - protein, 18 aa, Artificial Sequence
  Description of Artificial Sequence: Synthetic peptide
ATAADIVVVVAPDSPFDC

SEQ ID NO: 601 - protein, 107 aa, Artificial Sequence
  Description of Artificial Sequence: Synthetic polypeptide
DIQMTQSPSSLSASVGDRVTITCRASQSISYYLNWYQQKPGKAPKLLIYAASSLQSGVPSRFSGSGSGTDFTLTITSLQPEDFATYYCQQSYSTLLTFGGGTKVEIK

SEQ ID NO: 602 - protein, 9 aa, Artificial Sequence
  Description of Artificial Sequence: Synthetic peptide
QQSYSTLLT

SEQ ID NO: 603 - protein, 123 aa, Artificial Sequence
  Description of Artificial Sequence: Synthetic polypeptide
EVQLVESGGGLVKPGGSLRLSCAASGFTFSSYSMNWVRQAPGKGLAWVSSISSSNNIIYYADSVKGRFTISRDDAKDSLYLHMKSLRADDTAVYFCARVPSWAPYQLLPGPFDYWGQGILVTV

SEQ ID NO: 604 - protein, 18 aa, Artificial Sequence
  Description of Artificial Sequence: Synthetic peptide
ARVPSWAPYQLLPGPFDY

SEQ ID NO: 605 - protein, 107 aa, Artificial Sequence
  Description of Artificial Sequence: Synthetic polypeptide
DIQMTQSPSSLSASVGDRVTITCQASQAIASYLSWYQHKPGRAPKLLIYDASNLEIGVPSRFSGSGSGTDFTFTISSLQSEDNATYYCQQYESLPGTFGGGTKVEIK

SEQ ID NO: 606 - protein, 9 aa, Artificial Sequence
  Description of Artificial Sequence: Synthetic peptide
QQYESLPGT

SEQ ID NO: 607 - protein, 122 aa, Artificial Sequence; identical to SEQ ID NO: 37
  Description of Artificial Sequence: Synthetic polypeptide

SEQ ID NO: 608 - protein, 13 aa, Artificial Sequence
  Description of Artificial Sequence: Synthetic peptide
TTTNDYGDYSPAY

SEQ ID NO: 609 - protein, 112 aa, Artificial Sequence
  Description of Artificial Sequence: Synthetic polypeptide
DIVMTQSPDSLAVSLGERATINCKSSQSILYVSNNKNYLAWYQQKPGQPPKLLIYWASTRESGVPDRFSGSGSGTDFTLTIGSLQAEDVAVYYCQQYYSPPPTFGQGTKVEI

SEQ ID NO: 610 - protein, 9 aa, Artificial Sequence
  Description of Artificial Sequence: Synthetic peptide
QQYYSPPPT

SEQ ID NO: 611 - protein, 121 aa, Artificial Sequence
  Description of Artificial Sequence: Synthetic polypeptide
QVQLVESGGGVVQPGRTLRLSCAASGFIFSDYGMHWVRQAPGKGLEWVAVIWYDGSNKYYADSVKGRFTISRDNSKNTLSLQMSSLRAEDTAVYYCARLATIPYFYYMDVWGKGTTVTVSS

SEQ ID NO: 612 - protein, 14 aa, Artificial Sequence
  Description of Artificial Sequence: Synthetic peptide
ARLATIPYFYYMDV

SEQ ID NO: 613 - protein, 108 aa, Artificial Sequence
  Description of Artificial Sequence: Synthetic polypeptide
EIVMTQSPATLSVSPGERATLSCRASQSVSNKLAWYQQKPGQAPRLLIYGASTRATDIPARFSGSGSGTEFTLTISSLQSEDFAVYYCQQYSNWPPLTFGGGTKVEIK

SEQ ID NO: 614 - protein, 10 aa, Artificial Sequence
  Description of Artificial Sequence: Synthetic peptide
QQYSNWPPLT

SEQ ID NO: 615 - protein, 121 aa, Artificial Sequence; identical to SEQ ID NO: 57
  Description of Artificial Sequence: Synthetic polypeptide

SEQ ID NO: 616 - protein, 14 aa, Artificial Sequence
  Description of Artificial Sequence: Synthetic peptide
ARGVVGATPGSFDL

SEQ ID NO: 617 - protein, 107 aa, Artificial Sequence
  Description of Artificial Sequence: Synthetic polypeptide
DIQMTQSPSSLSASVGDRVTITCRASQSISRYLNWYQQRPGRAPELLIYSASSLQSGVPSRFSASGSGTDFTLTISSLQPEDFATYYCQQSYETPPITFGQGTRLEI

SEQ ID NO: 618 - protein, 10 aa, Artificial Sequence
  Description of Artificial Sequence: Synthetic peptide
QQSYETPPIT

SEQ ID NO: 619 - protein, 122 aa, Artificial Sequence
  Description of Artificial Sequence: Synthetic polypeptide
QVQLVESGGGVVQPGRSLRLSCAASRFTFSSYGMHWVRQAPGKGLEWVAVIWHDGSNKYYADSVKGRFTISRDNSKNTVYLQMNSLRVEDTAVYYCARDESIMVTANEIDYWGQGTLVTVSS

SEQ ID NO: 620 - protein, 15 aa, Artificial Sequence
  Description of Artificial Sequence: Synthetic peptide
ARDESIMVTANEIDY

SEQ ID NO: 621 - protein, 108 aa, Artificial Sequence
  Description of Artificial Sequence: Synthetic polypeptide
DIQMTQSPVSLSASVGDRVTITCRASQTIISHLNWYQQKPGKAPNLLIYAASSLQSGVPSRFSGSGSGTDFTLTISSLQPEDFATYYCQQSYSTPPWTFGQGTKVEIK

SEQ ID NO: 622 - protein, 10 aa, Artificial Sequence
  Description of Artificial Sequence: Synthetic peptide
QQSYSTPPWT

SEQ ID NO: 623 - protein, 122 aa, Artificial Sequence
  Description of Artificial Sequence: Synthetic polypeptide
QVQLVQSGAEVKKPGASVKVSCKASGYTFTNHYMHWVRQAPGQGLEWMGIINPGGGSTSYAQKFQGRVTMTSDTSTSTVYMELSSLRSEDTAVYYCAKDRGIIVSRDAFDIWGQGTMVTVSS

SEQ ID NO: 624 - protein, 15 aa, Artificial Sequence
  Description of Artificial Sequence: Synthetic peptide
AKDRGIIVSRDAFDI

SEQ ID NO: 625 - protein, 107 aa, Artificial Sequence
  Description of Artificial Sequence: Synthetic polypeptide
DIQMTQSPVSLSASVGDRVTITCRASQSIGNWLAWYQQKPGKAPNLLIYKASSLESGVPSRFSGSGSGTEFTLTISSLQPDDFATYYCQQYNNYSWTFGQGTKVEIK

SEQ ID NO: 626 - protein, 9 aa, Artificial Sequence
  Description of Artificial Sequence: Synthetic peptide
QQYNNYSWT

SEQ ID NO: 627 - protein, 120 aa, Artificial Sequence
  Description of Artificial Sequence: Synthetic polypeptide
QVQLVESGGGVVQPGRSLRLSCAASGFTFSDYAMHWVRQAPGKGLEWVAVIWDDGRTKHYADSVKGRFTISRDKAKNTLYLQMNSLRAEDTAIYYCARDWGTLTTLFDYWGQGALVTVSS

SEQ ID NO: 628 - protein, 13 aa, Artificial Sequence
  Description of Artificial Sequence: Synthetic peptide
ARDWGTLTTLFDY

SEQ ID NO: 629 - protein, 108 aa, Artificial Sequence
  Description of Artificial Sequence: Synthetic polypeptide
DIQMTQSPSSLSASVGDRVTITCRASQTIISHLNWYQQKPGKAPNLLIYAASSLQSGVPSRFSGSGSGTDFTLTISSLQPEDFATYYCQQSYSTPPWTFGQGTKVEIK

SEQ ID NO: 630 - protein, 10 aa, Artificial Sequence
  Description of Artificial Sequence: Synthetic peptide
QQSYSTPPWT

SEQ ID NO: 631 - protein, 129 aa, Artificial Sequence
  Description of Artificial Sequence: Synthetic polypeptide
EVQLVESGGGLVQPGGSLRLSCAASGFIFRSFWMYWVRQAPGKGLVWVSRISSDGSRTAYADSVKGRFTISRDNTKDTLYLQMNSLRAEDTAVYYCARVPRDYYDRTGNHHVDEYFQHWGQGTLVSVSS

SEQ ID NO: 632 - protein, 22 aa, Artificial Sequence
  Description of Artificial Sequence: Synthetic peptide
ARVPRDYYDRTGNHHVDEYFQH

SEQ ID NO: 633 - protein, 107 aa, Artificial Sequence
  Description of Artificial Sequence: Synthetic polypeptide
EIVLTQSPGTLSLSPGERATLFCRASQSVTSSDLAWYQQKPGQAPRLLISGASSRATGIPDRFIGSGSGTDFTLTISGLAPEDFAVYYCQQYASSPYTFGQGTKLEI

SEQ ID NO: 634 - protein, 9 aa, Artificial Sequence
  Description of Artificial Sequence: Synthetic peptide
QQYASSPYT

SEQ ID NO: 635 - protein, 122 aa, Artificial Sequence
  Description of Artificial Sequence: Synthetic polypeptide
QVQLVQSGAAVKKPGASVKVSCKASGYTFTTYYMHWVRQAPGQGLEWMGIINPSAGSTTYAQRFQGRVTMTTDTSTSTVYMELSSLRSEDTAVYYCARGALIPMVGAPFDYWGQGTLVTVSS

SEQ ID NO: 636 - protein, 15 aa, Artificial Sequence
  Description of Artificial Sequence: Synthetic peptide
ARGALIPMVGAPFDY

SEQ ID NO: 637 - protein, 108 aa, Artificial Sequence
  Description of Artificial Sequence: Synthetic polypeptide
DIQMTQSPSTLSASVGDRVTITCRASQSIGTGLAWYQQKPGTAPKVLIYKASTLESGVPSRFSGSGSGTEFTLTISSLQPDDFATYYCQYYSSYSPGYTFGQGTTLEI

SEQ ID NO: 638 - protein, 11 aa, Artificial Sequence
  Description of Artificial Sequence: Synthetic peptide
QYYSSYSPGYT

SEQ ID NO: 639 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGRSIPMLGVTTSAQKFKGRVTITADHSTSTVFMDLSSLRSDDTAIYYCARGVVGATPGSFDLWGQGTMVTVSS

SEQ ID NO: 640 - protein, 14 aa, Artificial Sequence
  Description of Artificial Sequence: Synthetic peptide
ARGVVGATPGSFDL

SEQ ID NO: 641 - protein, 103 aa, Artificial Sequence
  Description of Artificial Sequence: Synthetic polypeptide
EIVLTQSPATLSLSPGERATLSCRASQSVSNYLAWYQQKPGQAPRLLIYDASNRATGIPARFSGSGSGTDFTLTISSLEPEDFAVYYCQQRITFGQGTRLEIK

SEQ ID NO: 642 - protein, 5 aa, Artificial Sequence
  Description of Artificial Sequence: Synthetic peptide
QQRIT

SEQ ID NO: 643 - protein, 120 aa, Artificial Sequence
  Description of Artificial Sequence: Synthetic polypeptide
QVQLVESGGGVVHPARSLRLSCAASGFTFSSYGMHWVRQTPGKGLEWVAVISYDGSYKDYADSVKGRFTISRDNSKNTLYLQLNSLRAEDTAVYYCARDYGPMVTYHDYWGQGTLVTVSS

SEQ ID NO: 644 - protein, 13 aa, Artificial Sequence
  Description of Artificial Sequence: Synthetic peptide
ARDYGPMVTYHDY

SEQ ID NO: 645 - protein, 108 aa, Artificial Sequence
  Description of Artificial Sequence: Synthetic polypeptide
DIQMTQSPSSLSASVGDRVTITCRASQSISSYLNWYQQKPGKAPKLLFYTASSLQSGVPSRFSGSGSGTDFTLTISSLQPEDFATYYCQQSYSTPPWTFGQGTKVEIK

SEQ ID NO: 646 - protein, 10 aa, Artificial Sequence
  Description of Artificial Sequence: Synthetic peptide
QQSYSTPPWT

SEQ ID NO: 647 - protein, 123 aa, Artificial Sequence
  Description of Artificial Sequence: Synthetic polypeptide
EVQLLESGGDLVQPGGSLRLSCEASGFTFSIYAMSWVRQVPGTGLEWVSGFSGNTGDTHYADSVKGRFTISRDTSSNTLYLQMNSLRAGDTAIYYCAKHAMGGWYGFGAFDIWGQGTTVTVSS

SEQ ID NO: 648 - protein, 16 aa, Artificial Sequence
  Description of Artificial Sequence: Synthetic peptide
AKHAMGGWYGFGAFDI

SEQ ID NO: 649 - protein, 107 aa, Artificial Sequence
  Description of Artificial Sequence: Synthetic polypeptide
DIQLTQSPSFLSASVGDRVTITCRASQGIDSYLAWYQQTPGKAPKLLIYAASTLQSGVPSRFSGSGSGTDFTLTISSLQPEDFATYYCQRLNGYPWTFGQGTKVEIK

SEQ ID NO: 650 - protein, 9 aa, Artificial Sequence
  Description of Artificial Sequence: Synthetic peptide
QRLNGYPWT

SEQ ID NO: 651 - protein, 119 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDLQNRGGMDVWGQGTTVTVSS

SEQ ID NO: 652 - protein, 12 aa, Artificial Sequence
  Description of Artificial Sequence: Synthetic peptide
ARDLQNRGGMDV

SEQ ID NO: 653 - protein, 107 aa, Artificial Sequence
  Description of Artificial Sequence: Synthetic polypeptide
DIQMTQSPSSLSASVGDRVTITCQASHDISTYLNWYQHKPGKAPKVLIYDASNLQTGVPSRFSGSGSGTHFTFTISSLQPEDVATYYCHQYDNLPPTFGGGTKVELK

SEQ ID NO: 654 - protein, 9 aa, Artificial Sequence
  Description of Artificial Sequence: Synthetic peptide
HQYDNLPPT

SEQ ID NO: 655 - protein, 118 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMNSLRAEDTAIYYCARDVLERGGMDVWGQGTTVIVSS

SEQ ID NO: 656 - protein, 12 aa, Artificial Sequence
  Description of Artificial Sequence: Synthetic peptide
ARDVLERGGMDV

SEQ ID NO: 657 - protein, 108 aa, Artificial Sequence
  Description of Artificial Sequence: Synthetic polypeptide
EIVLTQSPGTLSLSPGERATLSCRASQSVGSSFLAWYQQRPGQAPRLLIYGASSRATGIPDRFSGSGFGTDFTLTISRLEPEDSAVYYCQQFGSSPFTFGPGTRVEIK

SEQ ID NO: 658 - protein, 9 aa, Artificial Sequence
  Description of Artificial Sequence: Synthetic peptide
QQFGSSPFT

SEQ ID NO: 659 - protein, 133 aa, Artificial Sequence
  Description of Artificial Sequence: Synthetic polypeptide
EVQLVESGGGLVQPGRSLRLSCVVSGFTLENYAMHWVRQAPGKGLEWVSGISWNSGTKGYADSVKGRFTISRDNAKNSLYLQMNSLRAEDTALYYCAKDNAPKNDYDFWTDNFGKHYYYGMDVWGQGTTVTVS

SEQ ID NO: 660 - protein, 27 aa, Artificial Sequence
  Description of Artificial Sequence: Synthetic peptide
AKDNAPKNDYDFWTDNFGKHYYYGMDV

SEQ ID NO: 661 - protein, 108 aa, Artificial Sequence
  Description of Artificial Sequence: Synthetic polypeptide
EIVLTQSPVSLSLSPGERATLSCRASQSVGSYLAWYQHKPGQAPRLLIYDALNRATGIPARFSGSGSGTDFTLTISSLEPEDFAVYYCQQRSNWPQLTFGGGTKVEIK

SEQ ID NO: 662 - protein, 10 aa, Artificial Sequence
  Description of Artificial Sequence: Synthetic peptide
QQRSNWPQLT

SEQ ID NO: 663 - protein, 126 aa, Artificial Sequence; identical to SEQ ID NO: 243
  Description of Artificial Sequence: Synthetic polypeptide

SEQ ID NO: 664 - protein, 19 aa, Artificial Sequence
  Description of Artificial Sequence: Synthetic peptide
AREMAGSGNYYWFGYGMDV

SEQ ID NO: 665 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSESGTDFTLTISSLQPEDFATYYCQQANSFPLTFGGGTKVEIK

SEQ ID NO: 666 - protein, 9 aa, Artificial Sequence
  Description of Artificial Sequence: Synthetic peptide
QQANSFPLT

SEQ ID NO: 667 - protein, 128 aa, Artificial Sequence
  Description of Artificial Sequence: Synthetic polypeptide
EVQLVESGGGLVQPGGSLRLSCAASGFTFSSYDMHWVRQVPGKGLEWVSGIGTAGDTYYPGSVKGRFTISREDAKHSLYLQLNSLRDGDTAVYYCARGDHRGSFHTFKTYYYYYMDVWGKGTTVTVSS

SEQ ID NO: 668 - protein, 22 aa, Artificial Sequence
  Description of Artificial Sequence: Synthetic peptide
ARGDHRGSFHTFKTYYYYYMDV

SEQ ID NO: 669 - protein, 109 aa, Artificial Sequence
  Description of Artificial Sequence: Synthetic polypeptide
DIQMTQSPSSLSASVGDRVTITCRASQSISSYLNWYQLKPGKAPKLLIYAASTLHSGVPSRFSGSGSGTEFTLTISSLQPEDFATYYCQQSYSNPPENAFGQGTKLEIE

SEQ ID NO: 670 - protein, 11 aa, Artificial Sequence
  Description of Artificial Sequence: Synthetic peptide
QQSYSNPPENA

SEQ ID NO: 671 - protein, 129 aa, Artificial Sequence
  Description of Artificial Sequence: Synthetic polypeptide
  MOD_RES (13)..(14): Any amino acid
QVQLVQSGAAVKXXGASVKVSCKAFGYTFTSYDIIWVRQATGQGLEWMGWMSPNNSNTGYAQKFQGRVTMTRDTSINTAYMELTSLRSEDTAVYYCARFGYYYVDSGPNRARYTGLDVWGQGTTVTVSS

SEQ ID NO: 672 - protein, 22 aa, Artificial Sequence
  Description of Artificial Sequence: Synthetic peptide
ARFGYYYVDSGPNRARYTGLDV

SEQ ID NO: 673 - protein, 107 aa, Artificial Sequence
  Description of Artificial Sequence: Synthetic polypeptide
EIVLTQSPGTLSLSPGERVTLSCRASQSVGANYLAWYQQKPGQAPRLLIYGTYNRATGIPDRFSGSGSGTDFTLTISRLEPEDFAVYYCQQYNRSPITFGQGTRLEI

SEQ ID NO: 674 - protein, 9 aa, Artificial Sequence
  Description of Artificial Sequence: Synthetic peptide
QQYNRSPIT

SEQ ID NO: 675 - protein, 132 aa, Artificial Sequence
  Description of Artificial Sequence: Synthetic polypeptide
EVQLLESGGGLVQPGGSLRLSCAASGFTFSNYAMNWVRQAPGRGLEWVSAISSGGDRTYYADSVKGRFSISRDRSRNNLYLQTNSLRAEDTAIYYCVKGPYFDFWSGSYDDLPYYYHGMDVWGQGTTVIVSS

SEQ ID NO: 676 - protein, 25 aa, Artificial Sequence
  Description of Artificial Sequence: Synthetic peptide
VKGPYFDFWSGSYDDLPYYYHGMDV

SEQ ID NO: 677 - protein, 112 aa, Artificial Sequence
  Description of Artificial Sequence: Synthetic polypeptide
DIVMTQTPLSSPVTLGQTASISCRSSQSLVHSDGTTYLSWLQQRPGQPPRLLIYKISNRFSGVPDRFSGSGAGTDFTLKISRVEAEDVGVYYCMQGTEFPHTFGQGTKLEIK

SEQ ID NO: 678 - protein, 9 aa, Artificial Sequence
  Description of Artificial Sequence: Synthetic peptide
MQGTEFPHT

SEQ ID NO: 679 - protein, 127 aa, Artificial Sequence
  Description of Artificial Sequence: Synthetic polypeptide
QVQLVESGGGVVQPGRSLRLSCAASGFAFSTYGMHWVRQTPGKGLAWVAAISYDGRNTYYGDSVKGRFTITRDNSKNTLYLQLNSLRDEDTALYYCARDATMITLVRGIMGPPFDHWGQGSLVTVSS

SEQ ID NO: 680 - protein, 20 aa, Artificial Sequence
  Description of Artificial Sequence: Synthetic peptide
ARDATMITLVRGIMGPPFDH

SEQ ID NO: 681 - protein, 106 aa, Artificial Sequence
  Description of Artificial Sequence: Synthetic polypeptide
DIQMTQSPSSLSASVGDRVTISCQASQGISNYLNWYQQKPGKAPKLLIHDASILETGVPSRFSGSGSGTDFTFTISSLQPEDIATYYCQQYDNFPPDFGPGTKVDI

SEQ ID NO: 682 - protein, 9 aa, Artificial Sequence
  Description of Artificial Sequence: Synthetic peptide
QQYDNFPPD

SEQ ID NO: 683 - protein, 128 aa, Artificial Sequence
  Description of Artificial Sequence: Synthetic polypeptide
QVQLQESGPGLVKPSETLSLTCAVSGGSVSSGNYYWNWIRQPPGKGLEWIGYIYYSGSTNYNPSLKSRVTISVDTSKNQFSLKLNSVTAADTAVYHCARETYYYDSSGYYISDAFDIWGQGTMVTVSS

SEQ ID NO: 684 - protein, 20 aa, Artificial Sequence
  Description of Artificial Sequence: Synthetic peptide
ARETYYYDSSGYYISDAFDI

SEQ ID NO: 685 - protein, 107 aa, Artificial Sequence; identical to SEQ ID NO: 230
  Description of Artificial Sequence: Synthetic polypeptide

SEQ ID NO: 686 - protein, 9 aa, Artificial Sequence
  Description of Artificial Sequence: Synthetic peptide
QQYNSFSYT

SEQ ID NO: 687 - protein, 120 aa, Artificial Sequence
  Description of Artificial Sequence: Synthetic polypeptide
QVQLVESGGGVVQPGRSLRLSCAASGFTFSSYVMNWVRQAPGKGLAWVAVISFDGSNKYYADSVKGRFTVSRDNSKNTLYLQMNSLRAEDTALYYCARGPGWQWPELDYWGQGTLVTVSS

SEQ ID NO: 688 - protein, 13 aa, Artificial Sequence
  Description of Artificial Sequence: Synthetic peptide
ARGPGWQWPELDY

SEQ ID NO: 689 - protein, 110 aa, Artificial Sequence
  Description of Artificial Sequence: Synthetic polypeptide
QSVLTQPPSASGTPGQRVTISCSGSSSNIGSNTVNWYQQLPGTGPKLLIYSNNERPSGVPDRFSGSKSGTSASLAISGLQPEDEADYYCAAWDDSLNGPVFGTGTKVTVL

SEQ ID NO: 690 - protein, 11 aa, Artificial Sequence
  Description of Artificial Sequence: Synthetic peptide
AAWDDSLNGPV

SEQ ID NO: 691 - protein, 126 aa, Artificial Sequence
  Description of Artificial Sequence: Synthetic polypeptide
EVQLVESGGGLVQPGRSLRLSCAASGFTFDDYAMHWVRQAPGKGLEWVSGVTWNSGSIGYADSVKGRFIISRDNAKNSLYLQMNSLRAEDTALYYCAKGGEGFRNWNDGLDYFDYWGQGTLVTVSS

SEQ ID NO: 692 - protein, 19 aa, Artificial Sequence
  Description of Artificial Sequence: Synthetic peptide
AKGGEGFRNWNDGLDYFDY

SEQ ID NO: 693 - protein, 110 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVL

SEQ ID NO: 694 - protein, 11 aa, Artificial Sequence
  Description of Artificial Sequence: Synthetic peptide
AAWDDSLNGYV

SEQ ID NO: 695 - protein, 128 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARGGYYYDSSGYEYYYYYGMDVWGQGTTVTVSS

SEQ ID NO: 696 - protein, 22 aa, Artificial Sequence
  Description of Artificial Sequence: Synthetic peptide
ARGGYYYDSSGYEYYYYYGMDV

SEQ ID NO: 697 - protein, 111 aa, Artificial Sequence
  Description of Artificial Sequence: Synthetic polypeptide
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYWVFGGGTKLTVL

SEQ ID NO: 698 - protein, 12 aa, Artificial Sequence
  Description of Artificial Sequence: Synthetic peptide
AAWDDSLSGYWV

SEQ ID NO: 699 - protein, 124 aa, Artificial Sequence
  Description of Artificial Sequence: Synthetic polypeptide
  MOD_RES (118)..(118): Any amino acid
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREVKRVVAAPEYYFDYWGQGXLVTVSS

SEQ ID NO: 700 - protein, 17 aa, Artificial Sequence
  Description of Artificial Sequence: Synthetic peptide
AREVKRVVAAPEYYFDY

SEQ ID NO: 701 - protein, 110 aa, Artificial Sequence
  Description of Artificial Sequence: Synthetic polypeptide
QSVLTQPPSASGTPGQRVTISCSGISSNLGSNTVNWFQQLPGTAPKLLIYNSNRRPSGVPDRFSGSKSGTSASLAISGLQSEDEGDYYCAEWDDSLSTWVFGGGTHLTVL

SEQ ID NO: 702 - protein, 11 aa, Artificial Sequence
  Description of Artificial Sequence: Synthetic peptide
AEWDDSLSTWV

SEQ ID NO: 703 - protein, 138 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGNRLLYCSSTSCYLDAVRQGYYYYYYMDVWGKGTTVTVSS

SEQ ID NO: 704 - protein, 31 aa, Artificial Sequence
  Description of Artificial Sequence: Synthetic polypeptide
ARGNRLLYCSSTSCYLDAVRQGYYYYYYMDV

SEQ ID NO: 705 - protein, 110 aa, Artificial Sequence
  Description of Artificial Sequence: Synthetic polypeptide
QSVLTQPPSASGTPGQRVTISCSGSSSNIGSNSVNWFQQLPGTAPKLLIYSNNQRPSGVPDRFSGSKSGASASLAISGLQSEDEADYYCASWDDSLNGPLFGGGTKLTVL

SEQ ID NO: 706 - protein, 11 aa, Artificial Sequence
  Description of Artificial Sequence: Synthetic peptide
ASWDDSLNGPL

SEQ ID NO: 707 - protein, 127 aa, Artificial Sequence
  Description of Artificial Sequence: Synthetic polypeptide
EVQLVESGGGLVKPGGSLRLSCAASGFTFSDAWMSWVRQAPGKGLEWVGRLKSKTDGGTTDYAAPVKGRFTISRDDSKNTLSLQMNSLKTEDTAVYYCTTDQIYGDYLRMPVPFDYWGQGTLVTVSS

SEQ ID NO: 708 - protein, 18 aa, Artificial Sequence
  Description of Artificial Sequence: Synthetic peptide
TTDQIYGDYLRMPVPFDY

SEQ ID NO: 709 - protein, 110 aa, Artificial Sequence
  Description of Artificial Sequence: Synthetic polypeptide
QSVLTQPPSASGTPGQRVTISCSGSSSNIGSNYVYWYQQLPGTAPKLLIYRNNQRPSGVPDRFSGSKSGTSASLAISGLRSEDEADYYCATWDDSLSGPVFGGGTKLTVL

SEQ ID NO: 710 - protein, 11 aa, Artificial Sequence
  Description of Artificial Sequence: Synthetic peptide
ATWDDSLSGPV

SEQ ID NO: 711 - protein, 125 aa, Artificial Sequence
  Description of Artificial Sequence: Synthetic polypeptide
QVQLVQSGAEVKKPGASVKVSCKASGYTFTGYYMHWVRQAPGQGLEWMGWINPISGGTNSAQKFQGRVTMTRDTSITTAYMELSSLRSDDTAVYHCAKSPYYYDSSGYLGGFDYWGQGTLVTVSS

SEQ ID NO: 712 - protein, 18 aa, Artificial Sequence
  Description of Artificial Sequence: Synthetic peptide
AKSPYYYDSSGYLGGFDY

SEQ ID NO: 713 - protein, 110 aa, Artificial Sequence
  Description of Artificial Sequence: Synthetic polypeptide
QSVLTQPASESGSPGQSITISCTGTSSDVGTYNLVSWYQQHPGKAPKLMIYEGSKRPSGVSNRFSGSKSGNTASLTISGLQAEDEADYYCCSYAASSTYVFGTGTKVTVL

SEQ ID NO: 714 - protein, 10 aa, Artificial Sequence
  Description of Artificial Sequence: Synthetic peptide
CSYAASSTYV

SEQ ID NO: 715 - protein, 121 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATEDYYDSSGSFDYWGQGTLVTVSS

SEQ ID NO: 716 - protein, 14 aa, Artificial Sequence
  Description of Artificial Sequence: Synthetic peptide
ATEDYYDSSGSFDY

SEQ ID NO: 717 - protein, 109 aa, Artificial Sequence
  Description of Artificial Sequence: Synthetic polypeptide
QSVLTQPRSVSGSPGQSVTISCTGTSSDVGGYNYVSWYQQHPGKAPKLMIYDVSKRPSGVPDRFSGSKSGNTASLTISGLQAEDEADYYCCSYAGSFWVFGGGTKLTVL

SEQ ID NO: 718 - protein, 9 aa, Artificial Sequence
  Description of Artificial Sequence: Synthetic peptide
CSYAGSFWV

SEQ ID NO: 719 - protein, 122 aa, Artificial Sequence
  Description of Artificial Sequence: Synthetic polypeptide
  MOD_RES (114)..(114): Any amino acid
QVQLVQSGAEVKKPGASVKVSCKASGYTFTGYYMHWVRQAPGQGLEWMGWINPNSGGRNYTQKFQGRVTMTRDTSISTAYMELSRLRSDDTAVYYCARDLGYSYVQGYFDYWGXGTLVTVSS

SEQ ID NO: 720 - protein, 15 aa, Artificial Sequence
  Description of Artificial Sequence: Synthetic peptide
ARDLGYSYVQGYFDY

SEQ ID NO: 721 - protein, 110 aa, Artificial Sequence
  Description of Artificial Sequence: Synthetic polypeptide
QSALTQPASESGSPGQSITISCTGTSSDVGSYNLVSWYQQHPGKAPKLMIYEGSKRPSGVSNRFSGSKSGNTASLTISGLQAEDEADYYCCSYAGSNTWVFGGGTKLTVL

SEQ ID NO: 722 - protein, 10 aa, Artificial Sequence
  Description of Artificial Sequence: Synthetic peptide
CSYAGSNTWV

SEQ ID NO: 723 - protein, 122 aa, Artificial Sequence
  Description of Artificial Sequence: Synthetic polypeptide
QVQLVQSGAEVKKPGASVKVSCKASGYIFTGYYMHWVRQAPGQGLEWMGWINPNSGGTNYAQKFQGRVTMTRDTSISTVYMELSRLRSDDTAVYYCARDLGFSRLQFLFDYWGQGTLVTVSS

SEQ ID NO: 724 - protein, 15 aa, Artificial Sequence
  Description of Artificial Sequence: Synthetic peptide
ARDLGFSRLQFLFDY

SEQ ID NO: 725 - protein, 110 aa, Artificial Sequence
  Description of Artificial Sequence: Synthetic polypeptide
QSVLTQPASVSGSPGQSITISCTGTSSDVGSYNLVSWYQQHPGKAPKLMIYEVSKRPSGVSNRFSGSKSGNTASLTISGLQAEDEADYYCCSYAGSSIVVFGGGTKLTVL

SEQ ID NO: 726 - protein, 10 aa, Artificial Sequence
  Description of Artificial Sequence: Synthetic peptide
CSYAGSSIVV

SEQ ID NO: 727 - protein, 125 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSPYYNPSLKSRVTISIDTSKNQFSLKLSSVTAADTAVYYCARVHVVRGVANYPYFDYWGQGTLVTVSS

SEQ ID NO: 728 - protein, 17 aa, Artificial Sequence
  Description of Artificial Sequence: Synthetic peptide
ARVHVVRGVANYPYFDY

SEQ ID NO: 729 - protein, 111 aa, Artificial Sequence
  Description of Artificial Sequence: Synthetic polypeptide
  MOD_RES (3)..(4): Any amino acid
QSXXTQPRSVSGSPGQSVTISCTGTSSDVGGYNCVSWYQQHPGKAPKLMIYDVSKRPSGVPDRFSGSKSGNTASLTISGLQAEDEADYYCCSYAGSYTPWVFGGGTKLTVL

SEQ ID NO: 730 - protein, 11 aa, Artificial Sequence
  Description of Artificial Sequence: Synthetic peptide
CSYAGSYTPWV

SEQ ID NO: 731 - protein, 126 aa, Artificial Sequence
  Description of Artificial Sequence: Synthetic polypeptide
QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCAREYFYDSSDYYFEYYFDYWGQGTLVTVSS

SEQ ID NO: 732 - protein, 19 aa, Artificial Sequence
  Description of Artificial Sequence: Synthetic peptide
AREYFYDSSDYYFEYYFDY

SEQ ID NO: 733 - protein, 110 aa, Artificial Sequence
  Description of Artificial Sequence: Synthetic polypeptide
QSVLTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTYVFGTGTKVTVL

SEQ ID NO: 734 - protein, 10 aa, Artificial Sequence
  Description of Artificial Sequence: Synthetic peptide
CSYAGSYTYV

SEQ ID NO: 735 - protein, 123 aa, Artificial Sequence
  Description of Artificial Sequence: Synthetic polypeptide
  MOD_RES (25)..(25): Any amino acid
  MOD_RES (32)..(32): Any amino acid
  MOD_RES (53)..(53): Any amino acid
  MOD_RES (80)..(80): Any amino acid
  MOD_RES (88)..(88): Any amino acid
  MOD_RES (122)..(123): Any amino acid
QVQLVQSGAEVKKPGASVKVSCKAXGYTFTRXHMQWVGQAPGQGLEWMGIINXSGGSTSYAQKFQGRVTMARDTSTSSVXMELSSLRXRTRPCITVLVGISTIVVVRPAVWTSGAKGPRSPXX

SEQ ID NO: 736 - protein, 17 aa, Artificial Sequence
  Description of Artificial Sequence: Synthetic peptide
LVGISTIVVVRPAVWTS

SEQ ID NO: 737 - protein, 115 aa, Artificial Sequence
  Description of Artificial Sequence: Synthetic polypeptide
QSVLTQPSSHSASSGASVRLTCMLSSGFSVGDFWIRWYQQKPGNPPRYLLYYHSDSNKGQGSGVPSRFSGSNDASANAGILRISGLQPEDEADYYCGTWHSNSRVFGGGTKLTVL

SEQ ID NO: 738 - protein, 9 aa, Artificial Sequence
  Description of Artificial Sequence: Synthetic peptide
GTWHSNSRV

SEQ ID NO: 739 - protein, 121 aa, Artificial Sequence
  Description of Artificial Sequence: Synthetic polypeptide
QVQLQESGPGLVKPSQTLSLTCTVSGGSFSSGGYYWHWIRQHPGKGLEWIGYIYYSGSTYYNPSLKSRVTISVDTSKNQFSLKLSSVTAADTAVYYCARVATDYGDSFDYWGQGTLVTVSS

SEQ ID NO: 740 - protein, 13 aa, Artificial Sequence
  Description of Artificial Sequence: Synthetic peptide
ARVATDYGDSFDY

SEQ ID NO: 741 - protein, 109 aa, Artificial Sequence
  Description of Artificial Sequence: Synthetic polypeptide
QSVLTQEPSLTVSPGGTVTLTCASSTGAVTSGYYPSWFQQKPGQAPRALIYSTSNKHSWTPARFSGSLLGGKAALTLSGVQPEDEADYYCLLYYGGAWVFGGGTKLTVL

SEQ ID NO: 742 - protein, 9 aa, Artificial Sequence
  Description of Artificial Sequence: Synthetic peptide
LLYYGGAWV

SEQ ID NO: 743 - protein, 123 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDSGGDIVVIPAVNGFDYWGQGTLVT

SEQ ID NO: 744 - protein, 19 aa, Artificial Sequence
  Description of Artificial Sequence: Synthetic peptide
ARDSGGDIVVIPAVNGFDY

SEQ ID NO: 745 - protein, 105 aa, Artificial Sequence
  Description of Artificial Sequence: Synthetic polypeptide
SYVLTQPPSVSVSPGQTARITCSGDALPNQYAYWYQQKPGQAPVLVIYKDSERPSGIPERFSGSSSGTTVTLTISGVQAEDEADYYCQSADSRGVFGGGTKLTVL

SEQ ID NO: 746 - protein, 8 aa, Artificial Sequence
  Description of Artificial Sequence: Synthetic peptide
QSADSRGV

SEQ ID NO: 747 - protein, 125 aa, Artificial Sequence
  Description of Artificial Sequence: Synthetic polypeptide
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARAWAMRQTTLTPEWIDYWGQGTLVTVSS

SEQ ID NO: 748 - protein, 18 aa, Artificial Sequence
  Description of Artificial Sequence: Synthetic peptide
ARAWAMRQTTLTPEWIDY

SEQ ID NO: 749 - protein, 106 aa, Artificial Sequence
  Description of Artificial Sequence: Synthetic polypeptide
SYVLTQPPSVSVSPGQTARITCSGDALPKQYAYWYQQKPGQAPVLVIYKDSERPSGIPERFSGSSSGTTVTLTISGVQAEDEADYYCQSADSRKVVFGGGTKLTVL

SEQ ID NO: 750 - protein, 9 aa, Artificial Sequence
  Description of Artificial Sequence: Synthetic peptide
QSADSRKVV

SEQ ID NO: 751 - protein, 126 aa, Artificial Sequence
  Description of Artificial Sequence: Synthetic polypeptide
  MOD_RES (118)..(118): Any amino acid
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARYYDILTGYYVDYYYMDVWGXGTTVTVSS

SEQ ID NO: 752 - protein, 19 aa, Artificial Sequence
  Description of Artificial Sequence: Synthetic peptide
ARYYDILTGYYVDYYYMDV

SEQ ID NO: 753 - protein, 108 aa, Artificial Sequence
  Description of Artificial Sequence: Synthetic polypeptide
SYVLTQPPSVSVSPGQTARITCSGDALPKQYAFWYQQKPGQAPVLVIYKDSERPSGIPERFSGSSSGTTVTLTISGVQAEDEADYYCQSADSSGTYVVFGGGTRLTVL

SEQ ID NO: 754 - protein, 11 aa, Artificial Sequence
  Description of Artificial Sequence: Synthetic peptide
QSADSSGTYVV

SEQ ID NO: 755 - protein, 119 aa, Artificial Sequence
  Description of Artificial Sequence: Synthetic polypeptide
EVQLVESGGGLVQPGGSLRLSCAASGFTFSSYWMSWVRQAPGKGLEWVTNIKLDGSEKYYVDSVKGRFTISRDNAKNSLYLQMNSLRAEDTAVYYCARLRWLRADFDYWGQGTLVTVSS

SEQ ID NO: 756 - protein, 12 aa, Artificial Sequence
  Description of Artificial Sequence: Synthetic peptide
ARLRWLRADFDY

SEQ ID NO: 757 - protein, 110 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSGNVVFGGGTKLTVL

SEQ ID NO: 758 - protein, 9 aa, Artificial Sequence
  Description of Artificial Sequence: Synthetic peptide
QSYDSGNVV

SEQ ID NO: 759 - protein, 124 aa, Artificial Sequence
  Description of Artificial Sequence: Synthetic polypeptide
QVQLQESGPGLVKPSETLSLTCTVSGGSISAYYWSWIRQPAGKGLEWIGRIYTSGSTIYNPSLKSRVTMSVDTSKNQFSLKLSSVTAADTAVYYCARDNGYVWGSYRPDAFDIWGQGTMVTVSS

SEQ ID NO: 760 - protein, 18 aa, Artificial Sequence
  Description of Artificial Sequence: Synthetic peptide
ARDNGYVWGSYRPDAFDI

SEQ ID NO: 761 - protein, 110 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRISGSIDSSSNSASLTISGLKTEDEADYYCQSYDSRNVVFGGGTRLTVL

SEQ ID NO: 762 - protein, 9 aa, Artificial Sequence
  Description of Artificial Sequence: Synthetic peptide
QSYDSRNVV

SEQ ID NO: 763 - protein, 123 aa, Artificial Sequence
  Description of Artificial Sequence: Synthetic polypeptide
QVQLQESGPGLVKPSETLSLTCTVSGGSISSYYWSWIRQPAGKGLEWIGRIYTSGSTNYNPSLESRVTMSVDTSKNQFSLKLSSVTAADTAVYYCARVVGYSSRGANYYMDVWGKGTTVTVSS

SEQ ID NO: 764 - protein, 17 aa, Artificial Sequence
  Description of Artificial Sequence: Synthetic peptide
ARVVGYSSRGANYYMDV

SEQ ID NO: 765 - protein, 111 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSDSLFGGGTKLTVL

SEQ ID NO: 766 - protein, 11 aa, Artificial Sequence
  Description of Artificial Sequence: Synthetic peptide
QSYDSSLSDSL

SEQ ID NO: 767 - protein, 120 aa, Artificial Sequence
  Description of Artificial Sequence: Synthetic polypeptide
QVQLVESGGGVVQPGRSLRLSCAASGFTFSSYCMHWVRQAPGKGLEWVAVIWYDGNNKYYADSVKGRFTISRDNSKNTLYLQMNSLRAEDTAVYYCAREKDIVATDFDYWGQGTLVTVSS

SEQ ID NO: 768 - protein, 13 aa, Artificial Sequence
  Description of Artificial Sequence: Synthetic peptide
AREKDIVATDFDY

SEQ ID NO: 769 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGPYVFGTGTKVTVL

SEQ ID NO: 770 - protein, 12 aa, Artificial Sequence
  Description of Artificial Sequence: Synthetic peptide
QSYDSSLSGPYV

SEQ ID NO: 771 - protein, 128 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADKSTSTAYMELSSLRSEDTAVCYCARVGYYYDRSGFPRTEDYFDYWGQGTLVTVSS

SEQ ID NO: 772 - protein, 21 aa, Artificial Sequence
  Description of Artificial Sequence: Synthetic peptide
ARVGYYYDRSGFPRTEDYFDY

SEQ ID NO: 773 - protein, 111 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVVFGGGTKLTVL

SEQ ID NO: 774 - protein, 11 aa, Artificial Sequence
  Description of Artificial Sequence: Synthetic peptide
QSYDSSLSGVV

SEQ ID NO: 775 - protein, 122 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARSYDSSGLSYNWFDPWGQGTLVTVSS

SEQ ID NO: 776 - protein, 16 aa, Artificial Sequence
  Description of Artificial Sequence: Synthetic peptide
ARSYDSSGLSYNWFDP

SEQ ID NO: 777 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVVFGGGTKLTVL

SEQ ID NO: 778 - protein, 12 aa, Artificial Sequence
  Description of Artificial Sequence: Synthetic peptide
QSYDSSLSGYVV

SEQ ID NO: 779 - protein, 119 aa, Artificial Sequence
  Description of Artificial Sequence: Synthetic polypeptide
QVQLVESGGGLVKPGGSLRLSCAASGFTFSDYYMSWIRQAPGKGLEWVSSISSSGSTIYYADSVKGRFTISRDNAKTSLYLQMNSLRAEDTAVYYCARGKWLRGSFDYWGQGTLVTVSS

SEQ ID NO: 780 - protein, 12 aa, Artificial Sequence
  Description of Artificial Sequence: Synthetic peptide
ARGKWLRGSFDY

SEQ ID NO: 781 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVL

SEQ ID NO: 782 - protein, 10 aa, Artificial Sequence
  Description of Artificial Sequence: Synthetic peptide
QSYDSSNHWV

SEQ ID NO: 783 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGTTYYADSVKGRFTISRDNSKNTLYLQMNSLRAEDTAVYYCAKVPIHYCSNGVCYFDYWGQGTLVTVSS

SEQ ID NO: 784 - protein, 17 aa, Artificial Sequence
  Description of Artificial Sequence: Synthetic peptide
AKVPIHYCSNGVCYFDY

SEQ ID NO: 785 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNRWVFGGGTKLTVL

SEQ ID NO: 786 - protein, 10 aa, Artificial Sequence
  Description of Artificial Sequence: Synthetic peptide
QSYDSSNRWV

SEQ ID NO: 787 - protein, 121 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLTSDDTAVYYCARGGQDELTGAFDIWGQGTMVTVSS

SEQ ID NO: 788 - protein, 14 aa, Artificial Sequence
  Description of Artificial Sequence: Synthetic peptide
ARGGQDELTGAFDI

SEQ ID NO: 789 - protein, 105 aa, Artificial Sequence
  Description of Artificial Sequence: Synthetic polypeptide
SYVLTQPPSVSVAPGKTARITCGGNSIGSKSVHWYQQKPGQAPVLVIYYDSDRPSGIPERFSGSNSGNTATLTISRVEAGDEADFHCQVWDSGWVFGGGTKLTVL

SEQ ID NO: 790 - protein, 8 aa, Artificial Sequence
  Description of Artificial Sequence: Synthetic peptide
QVWDSGWV

SEQ ID NO: 791 - protein, 128 aa, Artificial Sequence; identical to SEQ ID NO: 221
  Description of Artificial Sequence: Synthetic polypeptide

SEQ ID NO: 792 - protein, 21 aa, Artificial Sequence
  Description of Artificial Sequence: Synthetic peptide
AREAHDGALTDYGDYLNWFDP

SEQ ID NO: 793 - protein, 110 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHLYWVFGGGTKLTVL

SEQ ID NO: 794 - protein, 13 aa, Artificial Sequence
  Description of Artificial Sequence: Synthetic peptide
QVWDSSSDHLYWV

SEQ ID NO: 795 - protein, 125 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGTIGYADSVKGRFTISRDNAKNSLHLHMRSLRAEDTALYYCAKDGRSGDQWPELYYFDYWGQGTLVTVSS

SEQ ID NO: 796 - protein, 18 aa, Artificial Sequence
  Description of Artificial Sequence: Synthetic peptide
AKDGRSGDQWPELYYFDY

SEQ ID NO: 797 - protein, 108 aa, Artificial Sequence
  Description of Artificial Sequence: Synthetic polypeptide
SYVLTQPPSVSVAPGKTARITCGGNDIGSNGVYWYQQKPGQAPVLVIYYDSDRPSGIPERFSGSNSGNTATLTISRVEAGDEADYYCQVWDSSSDHVVFGGGTKLTVL

SEQ ID NO: 798 - protein, 11 aa, Artificial Sequence
  Description of Artificial Sequence: Synthetic peptide
QVWDSSSDHVV

SEQ ID NO: 799 - protein, 120 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARSSVTGTPPFDYWGQGTLVTVSS

SEQ ID NO: 800 - protein, 13 aa, Artificial Sequence
  Description of Artificial Sequence: Synthetic peptide
ARSSVTGTPPFDY

SEQ ID NO: 801 - protein, 108 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTAILTISRVEAGDEADYYCQVWDSSSDHVVFGGGTKLTVL

SEQ ID NO: 802 - protein, 11 aa, Artificial Sequence
  Description of Artificial Sequence: Synthetic peptide
QVWDSSSDHVV

SEQ ID NO: 803 - protein, 120 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARVPREGTPGFDPWGQGTLVTVSS

SEQ ID NO: 804 - protein, 13 aa, Artificial Sequence
  Description of Artificial Sequence: Synthetic peptide
ARVPREGTPGFDP

SEQ ID NO: 805 - protein, 108 aa, Artificial Sequence
  Description of Artificial Sequence: Synthetic polypeptide
SYVLTQPPSVSVAPGKTARITCGENNIGSKSVHWYQQKPGQAPVLVIYYDSDRPSGIPERFSGSNSGNTATLTINRVEAGDEADYYCQVWDSSSDHVVFGGGTKLTVL

SEQ ID NO: 806 - protein, 11 aa, Artificial Sequence
  Description of Artificial Sequence: Synthetic peptide
QVWDSSSDHVV

SEQ ID NO: 807 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSGISDSGVSTYNADSVKGRFTISRDNSKNTLYLQMNSLRAEDTAVYYCAKVWSISLDAFDIWGQGTMVTVSS

SEQ ID NO: 808 - protein, 13 aa, Artificial Sequence
  Description of Artificial Sequence: Synthetic peptide
AKVWSISLDAFDI

SEQ ID NO: 809 - protein, 106 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDLFGGGTKLTVL

SEQ ID NO: 810 - protein, 9 aa, Artificial Sequence
  Description of Artificial Sequence: Synthetic peptide
QVWDSSSDL

SEQ ID NO: 811 - protein, 120 aa, Artificial Sequence
  Description of Artificial Sequence: Synthetic polypeptide
EVQLVESGGGLVQPGRSLRLSCAASGFTFDDYAMHWVRQAPGKGLEWVSGISWNSVSIDYADSVKGRFTISRDNAKNSLYLQMNSLRAEDTALYYCAKDGAGTENWFDPWGQGTLVTVSS

SEQ ID NO: 812 - protein, 13 aa, Artificial Sequence
  Description of Artificial Sequence: Synthetic peptide
AKDGAGTENWFDP

SEQ ID NO: 813 - protein, 108 aa, Artificial Sequence
  Description of Artificial Sequence: Synthetic polypeptide
SYVLTQPPSVSVAPGKTARITCGGNNIGSKSVHWYQQKPGQAPLLVIYYDSDRPSGIPERFSGSNSGNTATLTISRVEAGDETDYYCQVWDSSSDPHVVFGGGTKLTV

SEQ ID NO: 814 - protein, 12 aa, Artificial Sequence
  Description of Artificial Sequence: Synthetic peptide
QVWDSSSDPHVV

SEQ ID NO: 815 - protein, 122 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDSPFSGLGASNDYWGQGTLVTVSS

SEQ ID NO: 816 - protein, 15 aa, Artificial Sequence
  Description of Artificial Sequence: Synthetic peptide
ARDSPFSGLGASNDY

SEQ ID NO: 817 - protein, 110 aa, Artificial Sequence
  Description of Artificial Sequence: Synthetic polypeptide
QSVLTQPPSASGSPGQSVTISCTGTSSDVGGYNYVSWYQQHPGKAPKLMIYEVSKRPSGVPDRFSGSKSGNTASLTVSGLQAEDEADYYCSSDAGSNNVVFGGGTKLTVL

SEQ ID NO: 818 - protein, 10 aa, Artificial Sequence
  Description of Artificial Sequence: Synthetic peptide
SSDAGSNNVV

SEQ ID NO: 819 - protein, 122 aa, Artificial Sequence
  Description of Artificial Sequence: Synthetic polypeptide
QVQLVQSGAEVKKPGASVKVSCMASGYTFTGYYMHWVRQAPGQGLEWMGWINPNSGGTNYAQKFQGRVTMTRDTSISTAYMELSRLRSDDTAVYYCARDSPFSALGASNDYWGQGTLVTVSS

SEQ ID NO: 820 - protein, 15 aa, Artificial Sequence
  Description of Artificial Sequence: Synthetic peptide
ARDSPFSALGASNDY

SEQ ID NO: 821 - protein, 110 aa, Artificial Sequence; identical to SEQ ID NO: 449
  Description of Artificial Sequence: Synthetic polypeptide

SEQ ID NO: 822 - protein, 10 aa, Artificial Sequence
  Description of Artificial Sequence: Synthetic peptide
SSDAGSNNVV

SEQ ID NO: 823 - protein, 128 aa, Artificial Sequence
  Description of Artificial Sequence: Synthetic polypeptide
EVQLVESGGGLVKPGGSLRLSCAASGFTFSTYNMNWVRQAPGKGLEWVSSITSSSSYIYYADSVKGRFTISRDNAENSLYLQMNSLRAEDTAVYYCARDRNRYDFWSGYYRLVGFDPWGQGTLVTVSS

SEQ ID NO: 824 - protein, 21 aa, Artificial Sequence
  Description of Artificial Sequence: Synthetic peptide
ARDRNRYDFWSGYYRLVGFDP

SEQ ID NO: 825 - protein, 110 aa, Artificial Sequence
  Description of Artificial Sequence: Synthetic polypeptide
QSVLTQPPSASGSPGQSVTISCTGTSSDVGGYKYVSWYQQHPGKAPKLMIYEVSKRPSGVPDRFSGSKSGNTASLTVSGLQAEDEADYYCSSYAGSNNHVFGGGTKLTVL

SEQ ID NO: 826 - protein, 10 aa, Artificial Sequence
  Description of Artificial Sequence: Synthetic peptide
SSYAGSNNHV

SEQ ID NO: 827 - protein, 122 aa, Artificial Sequence
  Description of Artificial Sequence: Synthetic polypeptide
QVQLQESGPGLVKPSQTLSLTCTVSGGSISSGGYYWGWIRQHPGKGLEWIGYIYYSGSTYYNPSLKSRVTISVDTSKNQFSLKLSSVTAADTAVYYCARGSYSNYNGGLDYWGQGTLVTVSS

SEQ ID NO: 828 - protein, 14 aa, Artificial Sequence
  Description of Artificial Sequence: Synthetic peptide
ARGSYSNYNGGLDY

SEQ ID NO: 829 - protein, 110 aa, Artificial Sequence
  Description of Artificial Sequence: Synthetic polypeptide
QSVLTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 830 - protein, 10 aa, Artificial Sequence
  Description of Artificial Sequence: Synthetic peptide
SSYAGSNNWV

SEQ ID NO: 831 - protein, 124 aa, Artificial Sequence
  Description of Artificial Sequence: Synthetic polypeptide
QVQLVESGGGVVQPGRSLRLSCAASGFTFTSYGMHWVRQAPGKGLEWVAVIWYDGSNKYYADSVKGRFTISRDNSKNTLYLQMNSLRAEDTAVYYCARDMMIRGVAWYYYMDVWGKGTTVTVSS

SEQ ID NO: 832 - protein, 17 aa, Artificial Sequence
  Description of Artificial Sequence: Synthetic peptide
ARDMMIRGVAWYYYMDV

SEQ ID NO: 833 - protein, 109 aa, Artificial Sequence
  Description of Artificial Sequence: Synthetic polypeptide
QSVLTQPASVSGSPGQSITISCTGTSSDVGGYNYVSWYQQHPGKAPKLIIYNVSNRPSGVSNRFSGSKSGNTASLTISGLQAEDEADYYCSSYISSNTVFGGGTKLTVL

SEQ ID NO: 834 - protein, 9 aa, Artificial Sequence
  Description of Artificial Sequence: Synthetic peptide
SSYISSNTV

SEQ ID NO: 835 - protein, 126 aa, Artificial Sequence
  Description of Artificial Sequence: Synthetic polypeptide
EVQLVESGGGLVQPGRSLRLSCAASGFTFDDYAMHWVRQAPGKGLEWVSGTSWNSGTIGYADSVKGRFTISRDNAKNSLYLQMNSLRAEDTALYYCAKGRVVYAIDPDSVSPFDYWGQGTLVTVSS

SEQ ID NO: 836 - protein, 19 aa, Artificial Sequence
  Description of Artificial Sequence: Synthetic peptide
AKGRVVYAIDPDSVSPFDY

SEQ ID NO: 837 - protein, 111 aa, Artificial Sequence
  Description of Artificial Sequence: Synthetic polypeptide
QSVLTQPASVSGSPGQSITISCTGTSSGVGGYNFVSWYQQHPGKAPKLMIYDVSNRPSGVSNRFSGSKSGNTASLTISGLQAEDEADYHCSSYTSRSTLGVFGGGTKLTVL

SEQ ID NO: 838 - protein, 11 aa, Artificial Sequence
  Description of Artificial Sequence: Synthetic peptide
SSYTSRSTLGV

SEQ ID NO: 839 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYAHSVKGRFTISRDNAKNSLYLHMNSLRAEDTALYYCAKDMLGNYYYYAMVVWGQGTTVTVSS

SEQ ID NO: 840 - protein, 15 aa, Artificial Sequence
  Description of Artificial Sequence: Synthetic peptide
AKDMLGNYYYYAMVV

SEQ ID NO: 841 - protein, 112 aa, Artificial Sequence
  Description of Artificial Sequence: Synthetic polypeptide
QSALTQPASVSGSPGQSITISCTGTSSDVGGYNYVSWYQHHPGKAPKLMIYDVSNRPSGVSNRFSGSKSGNTASLTISGLQAEDEADYYCSSYTSSSTLEGVFGGGTKLTVL

SEQ ID NO: 842 - protein, 12 aa, Artificial Sequence
  Description of Artificial Sequence: Synthetic peptide
SSYTSSSTLEGV

SEQ ID NO: 843 - protein, 123 aa, Artificial Sequence
  Description of Artificial Sequence: Synthetic polypeptide
QVQLVQSGAEVKKPGASVKVSCKASGYTFTDYYLHWVRQAPGQGLEWMGWINPTSGGTKYAQKFQGRVTMTRDTSITTAYMEVNRLRSDDTAVYYCARDRPLWFGVEYGMDVWGQGTTVTVSS

SEQ ID NO: 844 - protein, 16 aa, Artificial Sequence
  Description of Artificial Sequence: Synthetic peptide
ARDRPLWFGVEYGMDV

SEQ ID NO: 845 - protein, 110 aa, Artificial Sequence
  Description of Artificial Sequence: Synthetic polypeptide
QSVLTQPASVSGSPGQSITISCTGTNSDVGGYNYVSWYQQHPGKAPKLMIYDVGNRPSGVSNRFSGSKSGNTASLTISGLQAEDEADYYCSSYTSSSTLVFGGGTKLTVL

SEQ ID NO: 846 - protein, 10 aa, Artificial Sequence
  Description of Artificial Sequence: Synthetic peptide
SSYTSSSTLV

SEQ ID NO: 847 - protein, 125 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCASTGYYILTGYEFGAMDVWGQGTTVTVSS

SEQ ID NO: 848 - protein, 18 aa, Artificial Sequence
  Description of Artificial Sequence: Synthetic peptide
ASTGYYILTGYEFGAMDV

SEQ ID NO: 849 - protein, 109 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTVFGTGTKVTVL

SEQ ID NO: 850 - protein, 9 aa, Artificial Sequence
  Description of Artificial Sequence: Synthetic peptide
SSYTSSSTV

SEQ ID NO: 851 - protein, 124 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKPRKRGDYYGSGSYDYWGQGTLVTVSS

SEQ ID NO: 852 - protein, 17 aa, Artificial Sequence
  Description of Artificial Sequence: Synthetic peptide
AKPRKRGDYYGSGSYDY

SEQ ID NO: 853 - protein, 110 aa, Artificial Sequence
  Description of Artificial Sequence: Synthetic polypeptide
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKLTVL

SEQ ID NO: 854 - protein, 10 aa, Artificial Sequence
  Description of Artificial Sequence: Synthetic peptide
SSYTSSSTVV

SEQ ID NO: 855 - protein, 113 aa, Artificial Sequence
  Description of Artificial Sequence: Synthetic polypeptide
QVQLVESGGGVVQPERSLRLSCAASGFTFSSYAMHWVRQAPGKGLEWVAVISYDGSNKYYADSVKGRFTISRDNSKNTLYLQMNSLRAEDTAVYYCARSKSYTSWGYYHMDVW

SEQ ID NO: 856 - protein, 16 aa, Artificial Sequence
  Description of Artificial Sequence: Synthetic peptide
ARSKSYTSWGYYHMDV

SEQ ID NO: 857 - protein, 110 aa, Artificial Sequence
  Description of Artificial Sequence: Synthetic polypeptide
QSVLTQPASVSGSPGQSITISCAGTSSDVGAYNYVSWYQQHPGKAPKLMIYDVSNRPSGVSNRFSGSKSGNTASLTISGLQAEDEADYYCSSYTSSSTWVFGGGTKLTVL

SEQ ID NO: 858 - protein, 10 aa, Artificial Sequence
  Description of Artificial Sequence: Synthetic peptide
SSYTSSSTWV

SEQ ID NO: 859 - protein, 129 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCATTEGQQLPHPPYYYYYYYMDVWGKGTTVTVSS

SEQ ID NO: 860 - protein, 22 aa, Artificial Sequence
  Description of Artificial Sequence: Synthetic peptide
ATTEGQQLPHPPYYYYYYYMDV

SEQ ID NO: 861 - protein, 110 aa, Artificial Sequence
  Description of Artificial Sequence: Synthetic polypeptide
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTYVFGTGTKVTVL

SEQ ID NO: 862 - protein, 10 aa, Artificial Sequence
  Description of Artificial Sequence: Synthetic peptide
SSYTSSSTYV

SEQ ID NO: 863 - protein, 125 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARYGMGELLTLRSEYYFDYWGQGTLVTVSS

SEQ ID NO: 864 - protein, 19 aa, Artificial Sequence
  Description of Artificial Sequence: Synthetic peptide
ARYGMGELLTLRSEYYFDY

SEQ ID NO: 865 - protein, 110 aa, Artificial Sequence
  Description of Artificial Sequence: Synthetic polypeptide
QSVLTQPRSVSGSPGQSVTISCTGTSSDVGGYNYVSWYQQHPGKAPKLMIYDVSKRPSGVPDRFSGSKSGNTASLTISGLQAEDEADYYCYSYAGSYTFVFGGGTKLTVL

SEQ ID NO: 866 - protein, 10 aa, Artificial Sequence
  Description of Artificial Sequence: Synthetic peptide
YSYAGSYTFV

SEQ ID NO: 867 - protein, 125 aa, Artificial Sequence
  Description of Artificial Sequence: Synthetic polypeptide
QVQLVESGGGLVKPGGSLRLSCAASGFIFSDYCMSWIRRAPGKGLEWLSYISNSGTTRYYADSVKGRFTISRDNGRNSLYLQMDSLSAEDTAVYYCARRGDGSSSIYYYNYMDVWGKGTTVTVSS

SEQ ID NO: 868 - protein, 18 aa, Artificial Sequence
  Description of Artificial Sequence: Synthetic peptide
ARRGDGSSSIYYYNYMDV

SEQ ID NO: 869 - protein, 110 aa, Artificial Sequence
  Description of Artificial Sequence: Synthetic polypeptide
  MOD_RES (110)..(110): Any amino acid
QSVLTQPPSASGTPGQRVTVSCSGSSSNIGSNTVNWYQQLPGTAPKLLIYSNNQRPSGVPDRFSGSKSGTSASLAISGLQSEDEADYFCAAWDDSLNGPVFGGGTKLTVX

SEQ ID NO: 870 - protein, 11 aa, Artificial Sequence
  Description of Artificial Sequence: Synthetic peptide
AAWDDSLNGPV

SEQ ID NO: 871 - protein, 125 aa, Artificial Sequence
  Description of Artificial Sequence: Synthetic polypeptide
QVQLVESGGGLVKPGGSLRLSCAASGFTFSDYCMSWIRQAPGKGLEWLSYISNSGTTRYYADSVKGRFTISRDNGRNSLYLQMNSLSAEDTAVYYCARRGDGSSSIYYYNYMDVWGKGTTVTVSS

SEQ ID NO: 872 - protein, 18 aa, Artificial Sequence
  Description of Artificial Sequence: Synthetic peptide
ARRGDGSSSIYYYNYMDV

SEQ ID NO: 873 - protein, 110 aa, Artificial Sequence
  Description of Artificial Sequence: Synthetic polypeptide
QSVLTQPPSASGTPGQRVTVSCSGSSSNIGSNTVNWYQQLPGTAPKLLIHSNNQRPSGVPDRFSGSKSGTSASLAISGLQSEDEADYYCAAWDDSLNGPVFGGGTKLTVL

SEQ ID NO: 874 - protein, 11 aa, Artificial Sequence
  Description of Artificial Sequence: Synthetic peptide
AAWDDSLNGPV

SEQ ID NO: 875 - protein, 125 aa, Artificial Sequence; identical to SEQ ID NO: 871
  Description of Artificial Sequence: Synthetic polypeptide

SEQ ID NO: 876 - protein, 18 aa, Artificial Sequence
  Description of Artificial Sequence: Synthetic peptide
ARRGDGSSSIYYYNYMDV

SEQ ID NO: 877 - protein, 110 aa, Artificial Sequence
  Description of Artificial Sequence: Synthetic polypeptide
QSVLTQPPSASGTPGQRVTVSCSGSSSNIGSNTINWYQQLPGTAPKLLIYSNNQRPSGVPDRFSGSKSGTSASLAISGLQSEDEANYYCAAWDDSLNGPVFGGGTKLTVL

SEQ ID NO: 878 - protein, 11 aa, Artificial Sequence
  Description of Artificial Sequence: Synthetic peptide
AAWDDSLNGPV

SEQ ID NO: 879 - protein, 117 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMNSLRAGDTAVYYCARDYGDFYFDYWGQGTLVTVSS

SEQ ID NO: 880 - protein, 11 aa, Artificial Sequence
  Description of Artificial Sequence: Synthetic peptide
ARDYGDFYFDY

SEQ ID NO: 881 - protein, 108 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPRTFGQGTKLEIK

SEQ ID NO: 882 - protein, 9 aa, Artificial Sequence
  Description of Artificial Sequence: Synthetic peptide
QQYGSSPRT

SEQ ID NO: 883 - protein, 117 aa, Artificial Sequence
  Description of Artificial Sequence: Synthetic polypeptide
EVQLVESGGGLIQPGGSLRLSCAASGFTVSSNYMTWVRQAPGKGLEWVSLIYSGGSTFYADSVKGRFTISRDSSKNTLYLQMNSLRAEDTAVYYCARGYGDYYFDYWGQGTLVTVSS

SEQ ID NO: 884 - protein, 11 aa, Artificial Sequence
  Description of Artificial Sequence: Synthetic peptide
ARGYGDYYFDY

SEQ ID NO: 885 - protein, 103 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDSATYYCQHLNGFGPGTKVDIK

SEQ ID NO: 886 - protein, 5 aa, Artificial Sequence
  Description of Artificial Sequence: Synthetic peptide
QHLNG

SEQ ID NO: 887 - protein, 118 aa, Artificial Sequence; identical to SEQ ID NO: 215
  Description of Artificial Sequence: Synthetic polypeptide

SEQ ID NO: 888 - protein, 12 aa, Artificial Sequence
  Description of Artificial Sequence: Synthetic peptide
ARDLYSSGGTDI

SEQ ID NO: 889 - protein, 108 aa, Artificial Sequence
  Description of Artificial Sequence: Synthetic polypeptide
EIVLTQSPVSLSLSPGERATLSCRASQSVSSSYLAWYQQKPGQAPRLLIYGASSRATGIPDRFSGSGSGTDFTLTISRLEPEDFAVYYCQQYGSSPGTFGQGTKVEIK

SEQ ID NO: 890 - protein, 9 aa, Artificial Sequence
  Description of Artificial Sequence: Synthetic peptide
QQYGSSPGT

SEQ ID NO: 891 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDHSLGVRGDGYGMDVWGQGTTVTVSS

SEQ ID NO: 892 - protein, 17 aa, Artificial Sequence
  Description of Artificial Sequence: Synthetic peptide
ARDHSLGVRGDGYGMDV

SEQ ID NO: 893 - protein, 107 aa, Artificial Sequence
  Description of Artificial Sequence: Synthetic polypeptide
AIQLTQSPSSLSASVGDRVTITCRASQGISSALAWYQQKPGKAPKFLIYDASSLESGVPSRFSGSGSGTDFTLTISSLQPEDFATYYCQQFNNYPLTFGGGTKVEIK

SEQ ID NO: 894 - protein, 9 aa, Artificial Sequence
  Description of Artificial Sequence: Synthetic peptide
QQFNNYPLT

SEQ ID NO: 895 - protein, 117 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDLSVFGMDVWGQGTTVTVSS

SEQ ID NO: 896 - protein, 11 aa, Artificial Sequence
  Description of Artificial Sequence: Synthetic peptide
ARDLSVFGMDV

SEQ ID NO: 897 - protein, 105 aa, Artificial Sequence
  Description of Artificial Sequence: Synthetic polypeptide
  MOD_RES (86)..(86): Any amino acid
DIQLTQSPSFLSASVGDRVTVTCRASQGISSYLAWYQQKPGKAPKLLIYAASTLQSGVPSRFSGSGSGTEFTLTISSLQPEDFATXYCQQVNSYSHFGGGSKAEI

SEQ ID NO: 898 - protein, 8 aa, Artificial Sequence
  Description of Artificial Sequence: Synthetic peptide
QQVNSYSH

SEQ ID NO: 899 - protein, 123 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSEDCSSTSCYLDYWGQGTLVTVSS

SEQ ID NO: 900 - protein, 16 aa, Artificial Sequence
  Description of Artificial Sequence: Synthetic peptide
ARDSEDCSSTSCYLDY

SEQ ID NO: 901 - protein, 113 aa, Artificial Sequence
  Description of Artificial Sequence: Synthetic polypeptide
  MOD_RES (9)..(9): Any amino acid
DIVMTQSPXSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGPGTKVDIK

SEQ ID NO: 902 - protein, 9 aa, Artificial Sequence
  Description of Artificial Sequence: Synthetic peptide
QQYYSTPFT

SEQ ID NO: 903 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKASGIYCSGGNCYSYYFDYWGQGTLVTVSS

SEQ ID NO: 904 - protein, 20 aa, Artificial Sequence
  Description of Artificial Sequence: Synthetic peptide
AKASGIYCSGGNCYSYYFDY

SEQ ID NO: 905 - protein, 106 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSTFGQGTKVEIK

SEQ ID NO: 906 - protein, 8 aa, Artificial Sequence
  Description of Artificial Sequence: Synthetic peptide
QQYNSYST

SEQ ID NO: 907 - protein, 124 aa, Artificial Sequence
  Description of Artificial Sequence: Synthetic polypeptide
QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS

SEQ ID NO: 908 - protein, 17 aa, Artificial Sequence
  Description of Artificial Sequence: Synthetic peptide
AKEGRPSDIVVVVAFDY

SEQ ID NO: 909 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 910 - protein, 9 aa, Artificial Sequence
  Description of Artificial Sequence: Synthetic peptide
QQSYSTPRT

SEQ ID NO: 911 - protein, 124 aa, Artificial Sequence; identical to SEQ ID NO: 907
  Description of Artificial Sequence: Synthetic polypeptide

SEQ ID NO: 912 - protein, 17 aa, Artificial Sequence
  Description of Artificial Sequence: Synthetic peptide
AKEGRPSDIVVVVAFDY

SEQ ID NO: 913 - protein, 107 aa, Artificial Sequence
  Description of Artificial Sequence: Synthetic polypeptide
  MOD_RES (9)..(9): Any amino acid
DIQMTQSPXSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 914 - protein, 9 aa, Artificial Sequence
  Description of Artificial Sequence: Synthetic peptide
QQSYSTPRT

SEQ ID NO: 915 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKAGGPYCSGGSCYSSYFDYWGQGTLVTVSS

SEQ ID NO: 916 - protein, 20 aa, Artificial Sequence
  Description of Artificial Sequence: Synthetic peptide
AKAGGPYCSGGSCYSSYFDY

SEQ ID NO: 917 - protein, 109 aa, Artificial Sequence
  Description of Artificial Sequence: Synthetic polypeptide
  MOD_RES (9)..(10): Any amino acid
EIVLTQSPXXLSLSPGERATLSCRASQSVSSRNLAWYQQKPGQAPRLLIDGASSRATGIPDRFSGSGSGTDFTLTISRLEPEDFAVYYCQQYGSSPAITFGQGTRLEIK

SEQ ID NO: 918 - protein, 10 aa, Artificial Sequence
  Description of Artificial Sequence: Synthetic peptide
QQYGSSPAIT

SEQ ID NO: 919 - protein, 126 aa, Artificial Sequence
  Description of Artificial Sequence: Synthetic polypeptide
EVQLVQSGAEVKKPGESLKISCKGSGYSFTTYCIGWVRQMPGKGLEWMGIIYPGDSDTRYSPSFQGQVTISADKSISTAYLQWSSLKASDTAMYYCARHWYYGDYGNYSYYYLDVWGKGTTVTVSS

SEQ ID NO: 920 - protein, 19 aa, Artificial Sequence
  Description of Artificial Sequence: Synthetic peptide
ARHWYYGDYGNYSYYYLDV

SEQ ID NO: 921 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPLTFGGGTKVEIK

SEQ ID NO: 922 - protein, 9 aa, Artificial Sequence
  Description of Artificial Sequence: Synthetic peptide
QQYNNWPLT

SEQ ID NO: 923 - protein, 117 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDWGDYYFDYWGQGTLVTVSS

SEQ ID NO: 924 - protein, 11 aa, Artificial Sequence
  Description of Artificial Sequence: Synthetic peptide
ARDWGDYYFDY

SEQ ID NO: 925 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIK

SEQ ID NO: 926 - protein, 9 aa, Artificial Sequence
  Description of Artificial Sequence: Synthetic peptide
QQYGSSPRT

SEQ ID NO: 927 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGDITYYADSVKGRFTISRDNSKNTLYLQMNSLRAEDTAVYYCAKDSGTAMVEIFDYWGQGTLVTVSS

SEQ ID NO: 928 - protein, 14 aa, Artificial Sequence
  Description of Artificial Sequence: Synthetic peptide
AKDSGTAMVEIFDY

SEQ ID NO: 929 - protein, 107 aa, Artificial Sequence
  Description of Artificial Sequence: Synthetic polypeptide
  MOD_RES (9)..(9): Any amino acid
DIQMTQSPXSLSASVGDRVTITCRASQSISSYLNWYQQKPGKAPKLLIYAASSLQSGVPSRFSGSGSGTDFTLTISSLQPEDFATYFCQQSYSSTLTFGGGTKVEIK

SEQ ID NO: 930 - protein, 9 aa, Artificial Sequence
  Description of Artificial Sequence: Synthetic peptide
QQSYSSTLT

SEQ ID NO: 931 - protein, 120 aa, Artificial Sequence
  Description of Artificial Sequence: Synthetic polypeptide
QVQLVESGGGLVKPGGSLRLSCAASGFIFSDYYMSWIRQAPGKGLEWVSYISSSASTIYYADSVKGRFTISRDNAKNSLYLQMNSLRAEDTAVYYCARGLVYTPYRFGYWGQGTLVTVSS

SEQ ID NO: 932 - protein, 13 aa, Artificial Sequence
  Description of Artificial Sequence: Synthetic peptide
ARGLVYTPYRFGY

SEQ ID NO: 933 - protein, 106 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQHDNVVTFGPGTKVEIK

SEQ ID NO: 934 - protein, 8 aa, Artificial Sequence
  Description of Artificial Sequence: Synthetic peptide
QQHDNVVT

SEQ ID NO: 935 - protein, 126 aa, Artificial Sequence
  Description of Artificial Sequence: Synthetic polypeptide
QVQLVESGGGVVQPGRSLRLSCAASGFTFSNYGMHWVRQAPGKGLEWVAVISYDGSNKYFADSVKGRFTISRDNSKNTLYLQMNSLRAEDTAVYYCARATCSGGSCLFGQNAFDIWGQGTMVTVSS

SEQ ID NO: 936 - protein, 19 aa, Artificial Sequence
  Description of Artificial Sequence: Synthetic peptide
ARATCSGGSCLFGQNAFDI

SEQ ID NO: 937 - protein, 113 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPPYTFGQGTKLEIK

SEQ ID NO: 938 - protein, 10 aa, Artificial Sequence
  Description of Artificial Sequence: Synthetic peptide
MQGTHWPPYT

SEQ ID NO: 939 - protein, 125 aa, Artificial Sequence
  Description of Artificial Sequence: Synthetic polypeptide
QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCARDGTSITLITEGDAFDIWGQGTMVTVSS

SEQ ID NO: 940 - protein, 18 aa, Artificial Sequence
  Description of Artificial Sequence: Synthetic peptide
ARDGTSITLITEGDAFDI

SEQ ID NO: 941 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSLPLTFGGGTKVEIK

SEQ ID NO: 942 - protein, 9 aa, Artificial Sequence
  Description of Artificial Sequence: Synthetic peptide
QQANSLPLT

SEQ ID NO: 943 - protein, 124 aa, Artificial Sequence; identical to SEQ ID NO: 907
  Description of Artificial Sequence: Synthetic polypeptide

SEQ ID NO: 944 - protein, 17 aa, Artificial Sequence
  Description of Artificial Sequence: Synthetic peptide
AKEGRPSDIVVVVAFDY

SEQ ID NO: 945 - protein, 107 aa, Artificial Sequence; identical to SEQ ID NO: 909
  Description of Artificial Sequence: Synthetic polypeptide

SEQ ID NO: 946 - protein, 9 aa, Artificial Sequence
  Description of Artificial Sequence: Synthetic peptide
QQSYSTPRT

SEQ ID NO: 947 - protein, 127 aa, Artificial Sequence
  Description of Artificial Sequence: Synthetic polypeptide
QVQLVESGGGVVQPGRSLRLSCAASGFTFRRYGIHWVRQAPGKGLEWVAVISYDGSNKYYADSVKGRFTISRDNSKNTLYLQMNSLRAEDTAVYYCAKASGEYCGGGSCYRGVFDYWGQGTLVTVSS

SEQ ID NO: 948 - protein, 20 aa, Artificial Sequence
  Description of Artificial Sequence: Synthetic peptide
AKASGEYCGGGSCYRGVFDY

SEQ ID NO: 949 - protein, 106 aa, Artificial Sequence
  Description of Artificial Sequence: Synthetic polypeptide
DIQMTQSPSSLSASVGDRVTITCQASQDISNYLNWYQQKPGKAPELLIYDASNLETGVPSRFSGSGSGTDFTFTISSLQPEDIATYYCQQYDNLPLTFGGGTKVEI

SEQ ID NO: 950 - protein, 9 aa, Artificial Sequence
  Description of Artificial Sequence: Synthetic peptide
QQYDNLPLT

SEQ ID NO: 951 - protein, 124 aa, Artificial Sequence; identical to SEQ ID NO: 907
  Description of Artificial Sequence: Synthetic polypeptide

SEQ ID NO: 952 - protein, 17 aa, Artificial Sequence
  Description of Artificial Sequence: Synthetic peptide
AKEGRPSDIVVVVAFDY

SEQ ID NO: 953 - protein, 107 aa, Artificial Sequence; identical to SEQ ID NO: 909
  Description of Artificial Sequence: Synthetic polypeptide

SEQ ID NO: 954 - protein, 9 aa, Artificial Sequence
  Description of Artificial Sequence: Synthetic peptide
QQSYSTPRT

SEQ ID NO: 955 - protein, 123 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARTMYYYDSSGSFDYWGQGTLVTVSS

SEQ ID NO: 956 - protein, 15 aa, Artificial Sequence
  Description of Artificial Sequence: Synthetic peptide
ARTMYYYDSSGSFDY

SEQ ID NO: 957 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPHTFGGGTKVEIK

SEQ ID NO: 958 - protein, 9 aa, Artificial Sequence
  Description of Artificial Sequence: Synthetic peptide
MQALQTPHT

SEQ ID NO: 959 - protein, 123 aa, Artificial Sequence
  Description of Artificial Sequence: Synthetic polypeptide
QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPHCSGGSCYDAFDIWGQGTMVTVSS

SEQ ID NO: 960 - protein, 16 aa, Artificial Sequence
  Description of Artificial Sequence: Synthetic peptide
AAPHCSGGSCYDAFDI

SEQ ID NO: 961 - protein, 108 aa, Artificial Sequence
  Description of Artificial Sequence: Synthetic polypeptide
  MOD_RES (9)..(9): Any amino acid
EIVLTQSPXSLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 962 - protein, 9 aa, Artificial Sequence
  Description of Artificial Sequence: Synthetic peptide
QQYGSSPWT

SEQ ID NO: 963 - protein, 127 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARVLYYYDSSGYPNLEYFQHWGQGTLVTVSS

SEQ ID NO: 964 - protein, 20 aa, Artificial Sequence
  Description of Artificial Sequence: Synthetic peptide
ARVLYYYDSSGYPNLEYFQH

SEQ ID NO: 965 - protein, 108 aa, Artificial Sequence
  Description of Artificial Sequence: Synthetic polypeptide
  MOD_RES (104)..(104): Any amino acid
DIQMTQSPSSLSASVGDRVTITCQASQDISNYLNWYQQKPGKAPKLLIYDASNLEAGVPSRFSGSGSGTDFTFTISSLQPEDIATYYCQQYDNLPSFTFGPGTXVDIK

SEQ ID NO: 966 - protein, 10 aa, Artificial Sequence
  Description of Artificial Sequence: Synthetic peptide
QQYDNLPSFT

SEQ ID NO: 967 - protein, 124 aa, Artificial Sequence; identical to SEQ ID NO: 907
  Description of Artificial Sequence: Synthetic polypeptide

SEQ ID NO: 968 - protein, 17 aa, Artificial Sequence
  Description of Artificial Sequence: Synthetic peptide
AKEGRPSDIVVVVAFDY

SEQ ID NO: 969 - protein, 107 aa, Artificial Sequence; identical to SEQ ID NO: 909
  Description of Artificial Sequence: Synthetic polypeptide

SEQ ID NO: 970 - protein, 9 aa, Artificial Sequence
  Description of Artificial Sequence: Synthetic peptide
QQSYSTPRT

SEQ ID NO: 971 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDDSSGYHYYFDYWGQGTLVTVSS

SEQ ID NO: 972 - protein, 14 aa, Artificial Sequence
  Description of Artificial Sequence: Synthetic peptide
AKDDSSGYHYYFDY

SEQ ID NO: 973 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYNTPPITFGPGTKVDIK

SEQ ID NO: 974 - protein, 10 aa, Artificial Sequence
  Description of Artificial Sequence: Synthetic peptide
QQSYNTPPIT

SEQ ID NO: 975 - protein, 131 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDGAVVRFLEWPTVGYYYYYMDVWGKGTTVTVSS

SEQ ID NO: 976 - protein, 24 aa, Artificial Sequence
  Description of Artificial Sequence: Synthetic peptide
ARDGAVVRFLEWPTVGYYYYYMDV

SEQ ID NO: 977 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGQGTRLEIK

SEQ ID NO: 978 - protein, 9 aa, Artificial Sequence
  Description of Artificial Sequence: Synthetic peptide
MQALQTPIT

SEQ ID NO: 979 - protein, 124 aa, Artificial Sequence
  Description of Artificial Sequence: Synthetic polypeptide
  MOD_RES (116)..(116): Any amino acid
QVQLQESGPGLVKPSQTLSLTCTVSGGSISSGGYYWSWIRQHPGKGLEWIGYIYYSGSTYYNPSLESRVTISVDTSKNQFSLKLSSVTAADTAVYYCASGELSAFGELFPHDYWGXGTLVTVSS

SEQ ID NO: 980 - protein, 16 aa, Artificial Sequence
  Description of Artificial Sequence: Synthetic peptide
ASGELSAFGELFPHDY

SEQ ID NO: 981 - protein, 107 aa, Artificial Sequence
  Description of Artificial Sequence: Synthetic polypeptide
EIVLTQSPATLSLSPGERATLSCRASQSVSTYLAWYQQKPGQAPRLLIYDASNRATGIPARFSGSGSGTDFTLTISSLEPEDFAVYYCQQRSNWLFTFGPGTKVDIK

SEQ ID NO: 982 - protein, 9 aa, Artificial Sequence
  Description of Artificial Sequence: Synthetic peptide
QQRSNWLFT

SEQ ID NO: 983 - protein, 124 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYSADSVKGRFTISRDNSKNTLYLQMNSLRAEDTAVYYCARDCGGDCYPTTDAFDIWGQGTMVTVSS

SEQ ID NO: 984 - protein, 17 aa, Artificial Sequence
  Description of Artificial Sequence: Synthetic peptide
ARDCGGDCYPTTDAFDI

SEQ ID NO: 985 - protein, 107 aa, Artificial Sequence
  Description of Artificial Sequence: Synthetic polypeptide
DIQMTQSPSSLSASVGDRVTITCRASQSISSYLNWYQQKPGIAPKLLIYAASSLQSGVPSRFSGIGSGTDFTLTISSLQPEDFATYYCQQSYSTPWTFGQGTKVEIK

SEQ ID NO: 986 - protein, 9 aa, Artificial Sequence
  Description of Artificial Sequence: Synthetic peptide
QQSYSTPWT

SEQ ID NO: 987 - protein, 128 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFYTANYAQKFQGRVTITADKSTSTAYMELSSLRSEDTAVYYCARDEGYCSGGSCYGYYYGMDVWGQGTTVTVSS

SEQ ID NO: 988 - protein, 21 aa, Artificial Sequence
  Description of Artificial Sequence: Synthetic peptide
ARDEGYCSGGSCYGYYYGMDV

SEQ ID NO: 989 - protein, 108 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPMYTFGQGTKLEIK

SEQ ID NO: 990 - protein, 10 aa, Artificial Sequence
  Description of Artificial Sequence: Synthetic peptide
QQYDNLPMYT

SEQ ID NO: 991 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKNQNSYGYLSYFDYWGQGTLVTVSS

SEQ ID NO: 992 - protein, 15 aa, Artificial Sequence
  Description of Artificial Sequence: Synthetic peptide
AKNQNSYGYLSYFDY

SEQ ID NO: 993 - protein, 107 aa, Artificial Sequence
  Description of Artificial Sequence: Synthetic polypeptide
DIQMTQSPSSLSASVGDRVTITCQASQDINNYLNWYQQKPGKAPKLLIYDASNLETGVPSRFSGSGSGTDFAFTISSLQPEDIATYYCQQYDNLPRTFGQGTKVEIK

SEQ ID NO: 994 - protein, 9 aa, Artificial Sequence
  Description of Artificial Sequence: Synthetic peptide
QQYDNLPRT

SEQ ID NO: 995 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSSKFYADSVKGRFTISRDNSKNTLYLQMNSLRAEDTAVYYCARDYGSSWYQVPDYWGQGTLVTVSS

SEQ ID NO: 996 - protein, 14 aa, Artificial Sequence
  Description of Artificial Sequence: Synthetic peptide
ARDYGSSWYQVPDY

SEQ ID NO: 997 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSRSGTDFTLTISSLQPEDFATYYCQQSYSTPPLTFGGGTKVEIK

SEQ ID NO: 998 - protein, 10 aa, Artificial Sequence
  Description of Artificial Sequence: Synthetic peptide
QQSYSTPPLT

SEQ ID NO: 999 - protein, 127 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARVPSVGDCSSTSCLYWYFDLWGRGTLVTVSS

SEQ ID NO: 1000 - protein, 21 aa, Artificial Sequence
  Description of Artificial Sequence: Synthetic peptide
ARVPSVGDCSSTSCLYWYFDL

SEQ ID NO: 1001 - protein, 106 aa, Artificial Sequence
  Description of Artificial Sequence: Synthetic polypeptide
DIQMTQSPVSLSASVGDRVTITCRASQSISSWLAWYQQKPGKAPKLLIYKASSLESGVPSRFSGSGSGTEFTLTISSLQPDDFATYYCQQYNSYSTFGQGTKVEIK

SEQ ID NO: 1002 - protein, 8 aa, Artificial Sequence
  Description of Artificial Sequence: Synthetic peptide
QQYNSYST

SEQ ID NO: 1003 - protein, 129 aa, Artificial Sequence
  Description of Artificial Sequence: Synthetic polypeptide
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARYCSGGSCHPPGQWLSDAFDIWGQGTMVTVSS

SEQ ID NO: 1004 - protein, 22 aa, Artificial Sequence
  Description of Artificial Sequence: Synthetic peptide
ARYCSGGSCHPPGQWLSDAFDI

SEQ ID NO: 1005 - protein, 106 aa, Artificial Sequence
  Description of Artificial Sequence: Synthetic polypeptide
  MOD_RES (9)..(9): Any amino acid
DIQMTQSPXSLSASVGDRVTITCRASQSISSYLNWYQQKPGKAPKLLIYAASSLQSGVPSRFSGSGSGTDFTLTISSLQPEDFATYYCQQSYSTWTFGQGTKVEIK

SEQ ID NO: 1006 - protein, 8 aa, Artificial Sequence
  Description of Artificial Sequence: Synthetic peptide
QQSYSTWT

SEQ ID NO: 1007 - protein, 128 aa, Artificial Sequence
  Description of Artificial Sequence: Synthetic polypeptide
QVQLVQSGAEVKKPGASVKVSCKASGYTFTGYYMHWVRQAPGQGLEWMGWLNPISGGTNYAQKFQGRVTMTRDTSISTAYMELSRLRSDDTAVYYCASPASRGYSGYDHGYYYYMDVWGKGTTVTVSS

SEQ ID NO: 1008 - protein, 21 aa, Artificial Sequence
  Description of Artificial Sequence: Synthetic peptide
ASPASRGYSGYDHGYYYYMDV

SEQ ID NO: 1009 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK

SEQ ID NO: 1010 - protein, 9 aa, Artificial Sequence
  Description of Artificial Sequence: Synthetic peptide
QQYDNLPIT

SEQ ID NO: 1011 - protein, 123 aa, Artificial Sequence
  Description of Artificial Sequence: Synthetic polypeptide
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARVGYDSSGYSGWYFDLWGRGTLVTVSS

SEQ ID NO: 1012 - protein, 17 aa, Artificial Sequence
  Description of Artificial Sequence: Synthetic peptide
ARVGYDSSGYSGWYFDL

SEQ ID NO: 1013 - protein, 108 aa, Artificial Sequence
  Description of Artificial Sequence: Synthetic polypeptide
DIQMTQSPSSLSASVGDRVTITCRASQSISSYLNWYQQKPGKAPKVLIYAASSLQSGVPSRFSGSGSGTDFTLTISSLQPEDFATYYCQQSYSTPPLTFGGGTKVEIK

SEQ ID NO: 1014 - protein, 10 aa, Artificial Sequence
  Description of Artificial Sequence: Synthetic peptide
QQSYSTPPLT

SEQ ID NO: 1015 - protein, 123 aa, Artificial Sequence
  Description of Artificial Sequence: Synthetic polypeptide
QVQLVESGGGVVQPGRSLRLSCAASGFTYSGYAMHWVRQAPGKGLEWVAVILDDGSNKYYADSVKGRFTISRDNSKNTLYLQMNSLRAEDTAVYYCARDGIVDTAMVTWFDYWGQGTLVTVSS

SEQ ID NO: 1016 - protein, 16 aa, Artificial Sequence
  Description of Artificial Sequence: Synthetic peptide
ARDGIVDTAMVTWFDY

SEQ ID NO: 1017 - protein, 108 aa, Artificial Sequence
  Description of Artificial Sequence: Synthetic polypeptide
DIQMTQSPSSLSASVGDRVTITCRASQSISSYLNWYHQKPGKAPKLLIYTASSLQSGVPSRFSGSGSGTDFTLTISSLQPEDFATYYCQQSYSTPPWTFGQGTKVEIK

SEQ ID NO: 1018 - protein, 10 aa, Artificial Sequence
  Description of Artificial Sequence: Synthetic peptide
QQSYSTPPWT

SEQ ID NO: 1019 - protein, 124 aa, Artificial Sequence; identical to SEQ ID NO: 907
  Description of Artificial Sequence: Synthetic polypeptide

SEQ ID NO: 1020 - protein, 17 aa, Artificial Sequence
  Description of Artificial Sequence: Synthetic peptide
AKEGRPSDIVVVVAFDY

SEQ ID NO: 1021 - protein, 107 aa, Artificial Sequence; identical to SEQ ID NO: 909
  Description of Artificial Sequence: Synthetic polypeptide

SEQ ID NO: 1022 - protein, 9 aa, Artificial Sequence
  Description of Artificial Sequence: Synthetic peptide
QQSYSTPRT

SEQ ID NO: 1023 - protein, 129 aa, Artificial Sequence
  Description of Artificial Sequence: Synthetic polypeptide
QLQLQESGPGLVKPSETLSVTCTVSGGSISSSRYYWGWIRQPPGKGLEWIGSIYYSGSTYYNPSLKSRVTISVDTSKNQFSLKLSSVTAADTAVYYCARHAAAYYDRSGYYFIEYFQHWGQGTLVTVSS

SEQ ID NO: 1024 - protein, 21 aa, Artificial Sequence
  Description of Artificial Sequence: Synthetic peptide
ARHAAAYYDRSGYYFIEYFQH

SEQ ID NO: 1025 - protein, 107 aa, Artificial Sequence
  Description of Artificial Sequence: Synthetic polypeptide
DIQMTQSPSTLSASVGDSVTITCRASQSISSWLAWYQQKPGKAPKLLIYKASSLESGVPSRFSGSGSGTEFTLTISSLQPDDFATYYCQQYNNYRYTFGQGTKLEIK

SEQ ID NO: 1026 - protein, 9 aa, Artificial Sequence
  Description of Artificial Sequence: Synthetic peptide
QQYNNYRYT

SEQ ID NO: 1027 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVIWHDGSNKYYADSVKGRFTISRDNSKNTLYLQMNSLRAEDTALYYCARDPSVVVTAIDFDYWGQGTLVTVSS

SEQ ID NO: 1028 - protein, 15 aa, Artificial Sequence
  Description of Artificial Sequence: Synthetic peptide
ARDPSVVVTAIDFDY

SEQ ID NO: 1029 - protein, 112 aa, Artificial Sequence
  Description of Artificial Sequence: Synthetic polypeptide
DVVMTQSPLSLPVTLGQPASISCRSSQSLVFSDGNTYLNWFQQRPGQSPRRLIYKVSNRDSGVPDRFSGSGSGTDFTLKISRVEAEDVGVYFCMQGTHWPWTFGQGTKVEIK

SEQ ID NO: 1030 - protein, 9 aa, Artificial Sequence
  Description of Artificial Sequence: Synthetic peptide
MQGTHWPWT

SEQ ID NO: 1031 - protein, 138 aa, Artificial Sequence; identical to SEQ ID NO: 703
  Description of Artificial Sequence: Synthetic polypeptide

SEQ ID NO: 1032 - protein, 31 aa, Artificial Sequence; identical to SEQ ID NO: 704
  Description of Artificial Sequence: Synthetic polypeptide

SEQ ID NO: 1033 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 1034 - protein, 9 aa, Artificial Sequence
  Description of Artificial Sequence: Synthetic peptide
QQRSNWPLT

SEQ ID NO: 1035 - protein, 124 aa, Artificial Sequence; identical to SEQ ID NO: 907
  Description of Artificial Sequence: Synthetic polypeptide

SEQ ID NO: 1036 - protein, 17 aa, Artificial Sequence
  Description of Artificial Sequence: Synthetic peptide
AKEGRPSDIVVVVAFDY

SEQ ID NO: 1037 - protein, 107 aa, Artificial Sequence; identical to SEQ ID NO: 909
  Description of Artificial Sequence: Synthetic polypeptide

SEQ ID NO: 1038 - protein, 9 aa, Artificial Sequence
  Description of Artificial Sequence: Synthetic peptide
QQSYSTPRT

SEQ ID NO: 1039 - protein, 124 aa, Artificial Sequence; identical to SEQ ID NO: 907
  Description of Artificial Sequence: Synthetic polypeptide

SEQ ID NO: 1040 - protein, 17 aa, Artificial Sequence
  Description of Artificial Sequence: Synthetic peptide
AKEGRPSDIVVVVAFDY

SEQ ID NO: 1041 - protein, 107 aa, Artificial Sequence; identical to SEQ ID NO: 909
  Description of Artificial Sequence: Synthetic polypeptide

SEQ ID NO: 1042 - protein, 9 aa, Artificial Sequence
  Description of Artificial Sequence: Synthetic peptide
QQSYSTPRT

SEQ ID NO: 1043 - protein, 122 aa, Artificial Sequence
  Description of Artificial Sequence: Synthetic polypeptide
EVQLLESGGGLVQPGGSLRLSCAASGFTFNSYAMSWVRQAPGKGLEWVSGISGSGDSTYYADSVKGRFTISRDNSKNTVYLQMNSLRAEDTAVYYCAKDGGRQWLVELLDYWGHGTLVTVSS

SEQ ID NO: 1044 - protein, 15 aa, Artificial Sequence
  Description of Artificial Sequence: Synthetic peptide
AKDGGRQWLVELLDY

SEQ ID NO: 1045 - protein, 107 aa, Artificial Sequence
  Description of Artificial Sequence: Synthetic polypeptide
DIQMTQSPSSLSASVGDRVTITCRASQSIASYLNWFQQKPGKAPKLLIYAASSLQSGVPSRFSGSGSGTDFTLTISSLQPEDFATYCCQQSYSSPPTFGQGTKLEIK

SEQ ID NO: 1046 - protein, 9 aa, Artificial Sequence
  Description of Artificial Sequence: Synthetic peptide
QQSYSSPPT

SEQ ID NO: 1047 - protein, 128 aa, Artificial Sequence
  Description of Artificial Sequence: Synthetic polypeptide
QVQLVQSGAEVKKPGASVKVSCKASGYTFTGYYMHWVRQAPGQGLEWMGWINPISGGTNYAQKFQGRVTMTRDTSISTAYMELSRLRSDDTAVYYCASPASRGYSGYDHGYYYYMDVWGKGTTVTVSS

SEQ ID NO: 1048 - protein, 21 aa, Artificial Sequence
  Description of Artificial Sequence: Synthetic peptide
ASPASRGYSGYDHGYYYYMDV

SEQ ID NO: 1049 - protein, 107 aa, Artificial Sequence; identical to SEQ ID NO: 1009
  Description of Artificial Sequence: Synthetic polypeptide

SEQ ID NO: 1050 - protein, 9 aa, Artificial Sequence
  Description of Artificial Sequence: Synthetic peptide
QQYDNLPIT

SEQ ID NO: 1051 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREHTPTDIVVVNVEYWGQGTLVTVSS

SEQ ID NO: 1052 - protein, 16 aa, Artificial Sequence
  Description of Artificial Sequence: Synthetic peptide
AREHTPTDIVVVNVEY

SEQ ID NO: 1053 - protein, 112 aa, Artificial Sequence
  Description of Artificial Sequence: Synthetic polypeptide
DVVMTQSPLSLPVTLGQPASISCRSSQSLVYIDGNTYLNWFQQRPGQSPRRLIYKVSNRDSGVPDRFSGSGSGTDFTLKISRVEAEDVGVYYCMQGTHWPYTFGQGTKLEIK

SEQ ID NO: 1054 - protein, 9 aa, Artificial Sequence
  Description of Artificial Sequence: Synthetic peptide
MQGTHWPYT

SEQ ID NO: 1055 - protein, 120 aa, Artificial Sequence
  Description of Artificial Sequence: Synthetic polypeptide
QVQLVESGGGVVQPGRSLRLSCAASGFTFSSYAMHWVRQAPGKGLEWVAVILYDGSNKYYADSVKGRFTISRDNSKNTLYLQMNSLRAEDTAVYYCARDQGMATTYFDYWGQGTLVTVSS

SEQ ID NO: 1056 - protein, 13 aa, Artificial Sequence
  Description of Artificial Sequence: Synthetic peptide
ARDQGMATTYFDY

SEQ ID NO: 1057 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYFCQQSYNTPPWTFGQGTKVEIK

SEQ ID NO: 1058 - protein, 10 aa, Artificial Sequence
  Description of Artificial Sequence: Synthetic peptide
QQSYNTPPWT

SEQ ID NO: 1059 - protein, 120 aa, Artificial Sequence
  Description of Artificial Sequence: Synthetic polypeptide
EVQLVESGGGLVQPGGSLRLSCAASGFTFSSYDMHWVRQATGKGLEWVSIIGTAGDTYYPGSVKGRFTISRENAKNSLYLQMNSLRAGDTAVYYCARGSYSNYVGYMDVWGKGTTVTVSS

SEQ ID NO: 1060 - protein, 14 aa, Artificial Sequence
  Description of Artificial Sequence: Synthetic peptide
ARGSYSNYVGYMDV

SEQ ID NO: 1061 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPGLTFGGGTKVEIK

SEQ ID NO: 1062 - protein, 10 aa, Artificial Sequence
  Description of Artificial Sequence: Synthetic peptide
QQSYSTPGLT

SEQ ID NO: 1063 - protein, 125 aa, Artificial Sequence; identical to SEQ ID NO: 747
  Description of Artificial Sequence: Synthetic polypeptide

SEQ ID NO: 1064 - protein, 18 aa, Artificial Sequence
  Description of Artificial Sequence: Synthetic peptide
ARAWAMRQTTLTPEWIDY

SEQ ID NO: 1065 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIK

SEQ ID NO: 1066 - protein, 9 aa, Artificial Sequence
  Description of Artificial Sequence: Synthetic peptide
QQYGSSPYT

SEQ ID NO: 1067 - protein, 126 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGTIGYADSVKGRFTISRDNAKNSLYLQMNSLRAEDTAFYYCAKAGVRGIAAAGPDLNFDHWGQGTLVTVSS

SEQ ID NO: 1068 - protein, 19 aa, Artificial Sequence
  Description of Artificial Sequence: Synthetic peptide
AKAGVRGIAAAGPDLNFDH

SEQ ID NO: 1069 - protein, 103 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRITFGQGTRLEIK

SEQ ID NO: 1070 - protein, 5 aa, Artificial Sequence
  Description of Artificial Sequence: Synthetic peptide
QQRIT

SEQ ID NO: 1071 - protein, 124 aa, Artificial Sequence; identical to SEQ ID NO: 907
  Description of Artificial Sequence: Synthetic polypeptide

SEQ ID NO: 1072 - protein, 17 aa, Artificial Sequence
  Description of Artificial Sequence: Synthetic peptide
AKEGRPSDIVVVVAFDY

SEQ ID NO: 1073 - protein, 107 aa, Artificial Sequence; identical to SEQ ID NO: 909
  Description of Artificial Sequence: Synthetic polypeptide

SEQ ID NO: 1074 - protein, 9 aa, Artificial Sequence
  Description of Artificial Sequence: Synthetic peptide
QQSYSTPRT

SEQ ID NO: 1075 - protein, 126 aa, Artificial Sequence
  Description of Artificial Sequence: Synthetic polypeptide
EVQLVESGGDLVKPGGSLRLSCAASGFTFNNAWMSWVRQAPGKGLEWVGRIKDKSDGETTDYAAPVQGRFTVSRDDSKNTLYLQMNSLKTEDTAVYYCTTGPHYDSSGYSYTVDSWGQGTLVTVSS

SEQ ID NO: 1076 - protein, 17 aa, Artificial Sequence
  Description of Artificial Sequence: Synthetic peptide
TTGPHYDSSGYSYTVDS

SEQ ID NO: 1077 - protein, 112 aa, Artificial Sequence
  Description of Artificial Sequence: Synthetic polypeptide
  MOD_RES (14)..(14): Any amino acid
DIVMTQSPLSLPVXPGEPASISCRSSQSLLHSNGFHFLEWYLQKPGQSPQLLIYSGSNRASGVPDRFSGSGSGTHFTLKISRVEAEDVGVYYCMQGLQTPLTFGGGTKVEIK

SEQ ID NO: 1078 - protein, 9 aa, Artificial Sequence
  Description of Artificial Sequence: Synthetic peptide
MQGLQTPLT

SEQ ID NO: 1079 - protein, 128 aa, Artificial Sequence; identical to SEQ ID NO: 1047
  Description of Artificial Sequence: Synthetic polypeptide

SEQ ID NO: 1080 - protein, 21 aa, Artificial Sequence
  Description of Artificial Sequence: Synthetic peptide
ASPASRGYSGYDHGYYYYMDV

SEQ ID NO: 1081 - protein, 107 aa, Artificial Sequence; identical to SEQ ID NO: 1009
  Description of Artificial Sequence: Synthetic polypeptide

SEQ ID NO: 1082 - protein, 9 aa, Artificial Sequence
  Description of Artificial Sequence: Synthetic peptide
QQYDNLPIT

SEQ ID NO: 1083 - protein, 124 aa, Artificial Sequence; identical to SEQ ID NO: 907
  Description of Artificial Sequence: Synthetic polypeptide

SEQ ID NO: 1084 - protein, 17 aa, Artificial Sequence
  Description of Artificial Sequence: Synthetic peptide
AKEGRPSDIVVVVAFDY

SEQ ID NO: 1085 - protein, 107 aa, Artificial Sequence; identical to SEQ ID NO: 909
  Description of Artificial Sequence: Synthetic polypeptide

SEQ ID NO: 1086 - protein, 9 aa, Artificial Sequence
  Description of Artificial Sequence: Synthetic peptide
QQSYSTPRT

SEQ ID NO: 1087 - protein, 117 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDYGDFYFDYWGQGTLVTVSS

SEQ ID NO: 1088 - protein, 11 aa, Artificial Sequence
  Description of Artificial Sequence: Synthetic peptide
ARDYGDFYFDY

SEQ ID NO: 1089 - protein, 107 aa, Artificial Sequence
  Description of Artificial Sequence: Synthetic polypeptide
DIQMTQSPSSLSASVGDRVTITCRASQGISNSLAWYQQKPGKAPKLLLYAASRLESGVPSRFSGSGSGTDYTLTINSLQPEDFATFYCQQYYSTPRTFGQGTKVEIK

SEQ ID NO: 1090 - protein, 9 aa, Artificial Sequence
  Description of Artificial Sequence: Synthetic peptide
QQYYSTPRT

SEQ ID NO: 1091 - protein, 123 aa, Artificial Sequence
  Description of Artificial Sequence: Synthetic polypeptide
QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPHCSGGSCLDAFDIWGQGTMVTVSS

SEQ ID NO: 1092 - protein, 16 aa, Artificial Sequence
  Description of Artificial Sequence: Synthetic peptide
AAPHCSGGSCLDAFDI

SEQ ID NO: 1093 - protein, 108 aa, Artificial Sequence
  Description of Artificial Sequence: Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPWTFGQGTKVEIK

SEQ ID NO: 1094 - protein, 9 aa, Artificial Sequence
  Description of Artificial Sequence: Synthetic peptide
QQYGSSPWT

SEQ ID NO: 1095 - protein, 126 aa, Artificial Sequence
  Description of Artificial Sequence: Synthetic polypeptide
EVQLVESGGGLVKPGGSLRLSCAASGFTFSNAWMNWVRQAPGKGLEWVGRIKDKSDGGTIDYAAPVQGRFTISRDDSKNTLYLQMNSLKTEDTAVYYCTTGPHYDDSGYSYTVDYWGQGTLVTVSS

SEQ ID NO: 1096 - protein, 17 aa, Artificial Sequence
  Description of Artificial Sequence: Synthetic peptide
TTGPHYDDSGYSYTVDY

SEQ ID NO: 1097 - protein, 112 aa, Artificial Sequence
  Description of Artificial Sequence: Synthetic polypeptide
DIVMTQSPLSLPVTPGEPASISCRSSQSLLHSNGFHFLDWYLQKPGQTPQLLIYVGSNRASGVPDRFSGSGSGTDFTLKISRVEAEDVGVYYCMQALQTPLTFGGGTKVEIK

SEQ ID NO: 1098 - protein, 9 aa, Artificial Sequence
  Description of Artificial Sequence: Synthetic peptide
MQALQTPLT

SEQ ID NO: 1099 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKASGIYCSGGDCYSYYFDYWGQGTLVTVSS

SEQ ID NO: 1100 - protein, 20 aa, Artificial Sequence
  Description of Artificial Sequence: Synthetic peptide
AKASGIYCSGGDCYSYYFDY

SEQ ID NO: 1101 - protein, 106 aa, Artificial Sequence; identical to SEQ ID NO: 905
  Description of Artificial Sequence: Synthetic polypeptide

SEQ ID NO: 1102 - protein, 8 aa, Artificial Sequence
  Description of Artificial Sequence: Synthetic peptide
QQYNSYST

SEQ ID NO: 1103 - protein, 132 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTTYAQKFQGRVTMTRDTSTSTVYMELSSLRSEDTAVYYCARDRAETEGSETYYYDSSGYYLLGYWGQGTLVTVSS

SEQ ID NO: 1104 - protein, 25 aa, Artificial Sequence
  Description of Artificial Sequence: Synthetic peptide
ARDRAETEGSETYYYDSSGYYLLGY

SEQ ID NO: 1105 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPSFGQGTKVEIK

SEQ ID NO: 1106 - protein, 9 aa, Artificial Sequence
  Description of Artificial Sequence: Synthetic peptide
QQSYSTPPS

SEQ ID NO: 1107 - protein, 120 aa, Artificial Sequence
  Description of Artificial Sequence: Synthetic polypeptide
EVQLLESGGGLVQPGGSLRLSCAASRFTFSNYAMSWVRQAPGKGLEWVSTISGSGGSTYYADSVKGRFTISRDNSKNTLYLQMNSLRAEDTAVYYCAKDRAAAHWATDYWGQGTLVTVSS

SEQ ID NO: 1108 - protein, 13 aa, Artificial Sequence
  Description of Artificial Sequence: Synthetic peptide
AKDRAAAHWATDY

SEQ ID NO: 1109 - protein, 107 aa, Artificial Sequence
  Description of Artificial Sequence: Synthetic polypeptide
  MOD_RES (9)..(10): Any amino acid
DIQMTQSPXXLSASVGDRVTITCQASQDISNYLNWYQQKPGKAPKLLIYDASNLETGVPSRFSGSGSGTDFTFTISSLQPEDIATYYCQQYDNRLFTFGPGTKVDIK

SEQ ID NO: 1110 - protein, 9 aa, Artificial Sequence
  Description of Artificial Sequence: Synthetic peptide
QQYDNRLFT

SEQ ID NO: 1111 - protein, 122 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSSKYYADSVKGRFTISRDNSKNTLYLQMNSLRAEDTAVYYCARDHDYGEIVDAFDIWGQGTMVTVSS

SEQ ID NO: 1112 - protein, 15 aa, Artificial Sequence
  Description of Artificial Sequence: Synthetic peptide
ARDHDYGEIVDAFDI

SEQ ID NO: 1113 - protein, 107 aa, Artificial Sequence
  Description of Artificial Sequence: Synthetic polypeptide
DIQMTQSPSSLSASVGDRVTITCRASQSISSYLNWYQQRPGKAPKLLIYAASSLQSGFPSRFSGSGSGTDFTLTISSLQPEDFATYYCQQSYSTLMYTFGQGTKLEI

SEQ ID NO: 1114 - protein, 10 aa, Artificial Sequence
  Description of Artificial Sequence: Synthetic peptide
QQSYSTLMYT

SEQ ID NO: 1115 - protein, 129 aa, Artificial Sequence
  Description of Artificial Sequence: Synthetic polypeptide
  MOD_RES (121)..(121): Any amino acid
QLQLQESGPGLVKPSETLSLTCTVSGGSISSSNYYWGWIRQPPGKGLEWIGSIYYSGSTYYNPSLKSRVTISVDTSKNQFSLKVSSVTAADTAVYYCARHAAAYYDRSGYYFIEYFQHWGXGTLVTVSS

SEQ ID NO: 1116 - protein, 21 aa, Artificial Sequence
  Description of Artificial Sequence: Synthetic peptide
ARHAAAYYDRSGYYFIEYFQH

SEQ ID NO: 1117 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQKYNSYRYTFGQGTKLEIK

SEQ ID NO: 1118 - protein, 9 aa, Artificial Sequence
  Description of Artificial Sequence: Synthetic peptide
QKYNSYRYT

SEQ ID NO: 1119 - protein, 128 aa, Artificial Sequence
  Description of Artificial Sequence: Synthetic polypeptide
EVQLVQSGAEVKKPGESLKISCKGSGYSFSSYCIGWVRQMPGKGLEWMGIIYPGDSDTRYSPSFQGQVTISVDKSISTAYLQWSSLKASDTAMYYCARQWRGYYDRSGYYHFDAFDIWGQGTMVTVSS

SEQ ID NO: 1120 - protein, 21 aa, Artificial Sequence
  Description of Artificial Sequence: Synthetic peptide
ARQWRGYYDRSGYYHFDAFDI

SEQ ID NO: 1121 - protein, 107 aa, Artificial Sequence
  Description of Artificial Sequence: Synthetic polypeptide
EIVMTQSPATLSVSPGERATLSCRASQSVSSNLAWYQQKSGQAPRLLIYGASTRATGIPARFSGSGSGTEFTLTISSLQSEDFAVYYCQQYNNWLGTFGQGTKVEFK

SEQ ID NO: 1122 - protein, 9 aa, Artificial Sequence
  Description of Artificial Sequence: Synthetic peptide
QQYNNWLGT

SEQ ID NO: 1123 - protein, 123 aa, Artificial Sequence
  Description of Artificial Sequence: Synthetic polypeptide
QVQLVESGGGVVQPGRSLRLSCAASGFTFSSYAMHWVRQAPAKGLEWVAVILYDGSGKYYADSVKGRFTISRDNSKNTLYLQMNSLRAEDTAVYYCARDGIVDTALVTWFDYWGQGTLVTVSS

SEQ ID NO: 1124 - protein, 16 aa, Artificial Sequence
  Description of Artificial Sequence: Synthetic peptide
ARDGIVDTALVTWFDY

SEQ ID NO: 1125 - protein, 108 aa, Artificial Sequence
  Description of Artificial Sequence: Synthetic polypeptide
DIQMTQSPSSLSASVGDRVTITCRASQSISTYLNWYQQKPGKAPKLLIYAASSLQSGVPSRFSGSGSGTDFTLTISSLQPEDFATYYCQQSYSTPPWTFGQGTKVEIK

SEQ ID NO: 1126 - protein, 10 aa, Artificial Sequence
  Description of Artificial Sequence: Synthetic peptide
QQSYSTPPWT

SEQ ID NO: 1127 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVTVISYDGRNKYYADSVKGRFTISRDNSKNTLYLQMNSLRAEDTAVYYCAREFGDPEWYFDYWGQGTLVTVSS

SEQ ID NO: 1128 - protein, 13 aa, Artificial Sequence
  Description of Artificial Sequence: Synthetic peptide
AREFGDPEWYFDY

SEQ ID NO: 1129 - protein, 106 aa, Artificial Sequence
  Description of Artificial Sequence: Synthetic polypeptide
DIQMTQSPSTLSASVGDRVTITCRANQSISSWLAWYQQKPGKAPKLLIYKASSLESGVPSRFSGSGSGTEFTLTISSLQPDDFATYYCQQYNSYWTFGQGTKVEIK

SEQ ID NO: 1130 - protein, 8 aa, Artificial Sequence
  Description of Artificial Sequence: Synthetic peptide
QQYNSYWT

SEQ ID NO: 1131 - protein, 127 aa, Artificial Sequence
  Description of Artificial Sequence: Synthetic polypeptide
QVQLVESGGGVVQPGRSLRLSCAASGFTFSRYGMHWVRQAPGKGLEWVAVISYDGSNKYYADSVKGRFTISRDNSKNTLYLQMNSLRAEDTAVYYCAKVTAPYCSGGSCYGGNFDYWGQGTLVTVSS

SEQ ID NO: 1132 - protein, 20 aa, Artificial Sequence
  Description of Artificial Sequence: Synthetic peptide
AKVTAPYCSGGSCYGGNFDY

SEQ ID NO: 1133 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTINSLQPEDIATYYCQQYDNLPPTFGGGTKVEIK

SEQ ID NO: 1134 - protein, 9 aa, Artificial Sequence
  Description of Artificial Sequence: Synthetic peptide
QQYDNLPPT

SEQ ID NO: 1135 - protein, 124 aa, Artificial Sequence; identical to SEQ ID NO: 907
  Description of Artificial Sequence: Synthetic polypeptide

SEQ ID NO: 1136 - protein, 17 aa, Artificial Sequence
  Description of Artificial Sequence: Synthetic peptide
AKEGRPSDIVVVVAFDY

SEQ ID NO: 1137 - protein, 107 aa, Artificial Sequence; identical to SEQ ID NO: 909
  Description of Artificial Sequence: Synthetic polypeptide

SEQ ID NO: 1138 - protein, 9 aa, Artificial Sequence
  Description of Artificial Sequence: Synthetic peptide
QQSYSTPRT

SEQ ID NO: 1139 - protein, 126 aa, Artificial Sequence
  Description of Artificial Sequence: Synthetic polypeptide
EVQLVESGGGLVKPGGSLRLSCAASGFTFTNAWMNWVRQAPGKGLEWVGRIKAMTDGGTTDYAAPVQGRFTISRDDSRNTLYLQMNSLKTEDTAVYSCTTGPQYDDNGYSYTVDYWGQGTLVTVSS

SEQ ID NO: 1140 - protein, 17 aa, Artificial Sequence
  Description of Artificial Sequence: Synthetic peptide
TTGPQYDDNGYSYTVDY

SEQ ID NO: 1141 - protein, 112 aa, Artificial Sequence
  Description of Artificial Sequence: Synthetic polypeptide
  MOD_RES (25)..(25): Any amino acid
DIVMTQSPLSLPVTPGEPASISCRXSQSLLHSNGFHFVDWYLQKPGQSPHLLIYLGSNRASGVPDRFSGSGSGTDFTLKISRVEAEDVGVYYCMQALQTPLTFGGGTKVEIK

SEQ ID NO: 1142 - protein, 9 aa, Artificial Sequence
  Description of Artificial Sequence: Synthetic peptide
MQALQTPLT

SEQ ID NO: 1143 - protein, 124 aa, Artificial Sequence; identical to SEQ ID NO: 907
  Description of Artificial Sequence: Synthetic polypeptide

SEQ ID NO: 1144 - protein, 17 aa, Artificial Sequence
  Description of Artificial Sequence: Synthetic peptide
AKEGRPSDIVVVVAFDY

SEQ ID NO: 1145 - protein, 107 aa, Artificial Sequence; identical to SEQ ID NO: 909
  Description of Artificial Sequence: Synthetic polypeptide

SEQ ID NO: 1146 - protein, 9 aa, Artificial Sequence
  Description of Artificial Sequence: Synthetic peptide
QQSYSTPRT

SEQ ID NO: 1147 - protein, 121 aa, Artificial Sequence
  Description of Artificial Sequence: Synthetic polypeptide
QVQLVESGGGVVQPGRSLRLSCAASGFTFSNYAIHWVRQAPGKGLEWVAVISYDGSNKYYADSVKGRFTISRDNSKNTLYLQMNSLRAEDTAVYYCARDFDDSSFWAFDYWGQGTLVTVSS

SEQ ID NO: 1148 - protein, 14 aa, Artificial Sequence
  Description of Artificial Sequence: Synthetic peptide
ARDFDDSSFWAFDY

SEQ ID NO: 1149 - protein, 108 aa, Artificial Sequence
  Description of Artificial Sequence: Synthetic polypeptide
DIQMTQSPSSLSASVGDRVTITCRASQSIRSYLNWYQQKPGKAPKLLIYAASSLQSGVPSRFSGSGSGTDFTLTISSLQPDDFATYYCQQSYSTPPATFGQGTKLEIK

SEQ ID NO: 1150 - protein, 10 aa, Artificial Sequence
  Description of Artificial Sequence: Synthetic peptide
QQSYSTPPAT

SEQ ID NO: 1151 - protein, 122 aa, Artificial Sequence
  Description of Artificial Sequence: Synthetic polypeptide
EVQLVESGGGLVQPGGSLRLSCAASGFTFSSYDMHWVRQATGKGLEWVSTIGTAGDTYYPGSVKGRFTISRENAKNSLYLQMNSLRAGDTAVYYCARVGYSSGWAYWYVDLWGRGTLVTVSS

SEQ ID NO: 1152 - protein, 16 aa, Artificial Sequence
  Description of Artificial Sequence: Synthetic peptide
ARVGYSSGWAYWYVDL

SEQ ID NO: 1153 - protein, 108 aa, Artificial Sequence
  Description of Artificial Sequence: Synthetic polypeptide
DIQMTQSPSSLSASVGDRVTITCRASQSISSFLNWYQQKPGKAPKLLIYAASSLQSGVPSRFSGSGSGTDFTLTISSLQPEDFATYYCQQSYITPQYTFGQGTKVEIK

SEQ ID NO: 1154 - protein, 10 aa, Artificial Sequence
  Description of Artificial Sequence: Synthetic peptide
QQSYITPQYT

SEQ ID NO: 1155 - protein, 126 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKAGVRGIAAAGPDLNFDYWGQGTLVTVSS

SEQ ID NO: 1156 - protein, 19 aa, Artificial Sequence
  Description of Artificial Sequence: Synthetic peptide
AKAGVRGIAAAGPDLNFDY

SEQ ID NO: 1157 - protein, 103 aa, Artificial Sequence; identical to SEQ ID NO: 1069
  Description of Artificial Sequence: Synthetic polypeptide

SEQ ID NO: 1158 - protein, 5 aa, Artificial Sequence
  Description of Artificial Sequence: Synthetic peptide
QQRIT

SEQ ID NO: 1159 - protein, 123 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARVWQYYDSSGSFDYWGQGTLVTVSS

SEQ ID NO: 1160 - protein, 15 aa, Artificial Sequence
  Description of Artificial Sequence: Synthetic peptide
ARVWQYYDSSGSFDY

SEQ ID NO: 1161 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGTKVDIK

SEQ ID NO: 1162 - protein, 9 aa, Artificial Sequence
  Description of Artificial Sequence: Synthetic peptide
MQALQTPFT

SEQ ID NO: 1163 - protein, 123 aa, Artificial Sequence
  Description of Artificial Sequence: Synthetic polypeptide
EVQLVESGGGLVQPGGSLRLSCAASGFTFSSYDMHWVRQATGKGLEWVSTIGTAGDTYYPGSVKGRFTISRENAKNSLYLQLNSLRAGDTAVYYCARANYDSSGLGLGYFDYWGQGTLVTVSS

SEQ ID NO: 1164 - protein, 17 aa, Artificial Sequence
  Description of Artificial Sequence: Synthetic peptide
ARANYDSSGLGLGYFDY

SEQ ID NO: 1165 - protein, 108 aa, Artificial Sequence
  Description of Artificial Sequence: Synthetic polypeptide
DIQMTQSPSSLSASVGDRVTITCRASQRISSYLNWYQQKPGKAPKLLIYAASSLQSGVPSRFSGSGSGTDFTLTISSLQPEDFATYYCQQSYSTPPITFGQGTRLEIK

SEQ ID NO: 1166 - protein, 10 aa, Artificial Sequence
  Description of Artificial Sequence: Synthetic peptide
QQSYSTPPIT

SEQ ID NO: 1167 - protein, 123 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTTNYAQKFQGRVTITADESTSTTYMELSSLRSEDTAVYYCAREVDYCSSAYCYADYWGQGTLVTVSS

SEQ ID NO: 1168 - protein, 16 aa, Artificial Sequence
  Description of Artificial Sequence: Synthetic peptide
AREVDYCSSAYCYADY

SEQ ID NO: 1169 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGPGTKVDIK

SEQ ID NO: 1170 - protein, 9 aa, Artificial Sequence
  Description of Artificial Sequence: Synthetic peptide
QQYYSTPFT

SEQ ID NO: 1171 - protein, 123 aa, Artificial Sequence; identical to SEQ ID NO: 1159
  Description of Artificial Sequence: Synthetic polypeptide

SEQ ID NO: 1172 - protein, 15 aa, Artificial Sequence
  Description of Artificial Sequence: Synthetic peptide
ARVWQYYDSSGSFDY

SEQ ID NO: 1173 - protein, 112 aa, Artificial Sequence; identical to SEQ ID NO: 1161
  Description of Artificial Sequence: Synthetic polypeptide

SEQ ID NO: 1174 - protein, 9 aa, Artificial Sequence
  Description of Artificial Sequence: Synthetic peptide
MQALQTPFT

SEQ ID NO: 1175 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMSSLRAEDTAVYYCAKQIGEYCSGGSCYQGSLDYWGQGTLVTVSS

SEQ ID NO: 1176 - protein, 20 aa, Artificial Sequence
  Description of Artificial Sequence: Synthetic peptide
AKQIGEYCSGGSCYQGSLDY

SEQ ID NO: 1177 - protein, 107 aa, Artificial Sequence
  Description of Artificial Sequence: Synthetic polypeptide
DIQMTQSPVSLSASVGDRVTITCQASQDISNYLHWYQQKPGKAPKLLIYDASNLETGVPSRFSGSGSGTDFTFTISSLQPEDIATYYCQQYDNLPFTFGPGTKVDAK

SEQ ID NO: 1178 - protein, 9 aa, Artificial Sequence
  Description of Artificial Sequence: Synthetic peptide
QQYDNLPFT

SEQ ID NO: 1179 - protein, 126 aa, Artificial Sequence; identical to SEQ ID NO: 1075
  Description of Artificial Sequence: Synthetic polypeptide

SEQ ID NO: 1180 - protein, 17 aa, Artificial Sequence
  Description of Artificial Sequence: Synthetic peptide
TTGPHYDSSGYSYTVDS

SEQ ID NO: 1181 - protein, 112 aa, Artificial Sequence
  Description of Artificial Sequence: Synthetic polypeptide
DIVMTQSPLSLPVTPGEPASISCRSSQSLLHSTGFHFLEWYLQKPGQSPQLLIYSGSNRASGVPDRFSGSGSGTHFTLKISRVEAEDVGIYYCMQGLQTPLTFGGGTKVEIK

SEQ ID NO: 1182 - protein, 9 aa, Artificial Sequence
  Description of Artificial Sequence: Synthetic peptide
MQGLQTPLT

SEQ ID NO: 1183 - protein, 132 aa, Artificial Sequence; identical to SEQ ID NO: 1103
  Description of Artificial Sequence: Synthetic polypeptide

SEQ ID NO: 1184 - protein, 25 aa, Artificial Sequence
  Description of Artificial Sequence: Synthetic peptide
ARDRAETEGSETYYYDSSGYYLLGY

SEQ ID NO: 1185 - protein, 107 aa, Artificial Sequence; identical to SEQ ID NO: 1105
  Description of Artificial Sequence: Synthetic polypeptide

SEQ ID NO: 1186 - protein, 9 aa, Artificial Sequence
  Description of Artificial Sequence: Synthetic peptide
QQSYSTPPS

SEQ ID NO: 1187 - protein, 128 aa, Artificial Sequence
  Description of Artificial Sequence: Synthetic polypeptide
QVQLVESGGGLVKPGGSLRLSCAASGFTFSDYYMSWIRQAPGKGLEWVSYISSSGNSIYSADSVKGRFTISRDNAKNSLYLQMNSLRAEDTAVYYCATPPGGNPTYYYDTSGYSLAYWGQGTLVTVSS

SEQ ID NO: 1188 - protein, 21 aa, Artificial Sequence
  Description of Artificial Sequence: Synthetic peptide
ATPPGGNPTYYYDTSGYSLAY

SEQ ID NO: 1189 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYNVSNRDSGVPDRFSGSGSGTDFTLKISRVEAEDVGVYYCMQGTHWPPNFGQGTRLEIK

SEQ ID NO: 1190 - protein, 9 aa, Artificial Sequence
  Description of Artificial Sequence: Synthetic peptide
MQGTHWPPN

SEQ ID NO: 1191 - protein, 130 aa, Artificial Sequence
  Description of Artificial Sequence: Synthetic polypeptide
QLQLQESGPGLVKPSETLSLTCTVSGGSISSSNYYWGWIRQPPGKGLEWIGSIYYSGSTYYNPSLKSRVTISVDTSKSQFSLKLSSVTAADTAVYYCARALKYYDILTGYSEPRTFLDYWGQGTLVTVSS

SEQ ID NO: 1192 - protein, 22 aa, Artificial Sequence
  Description of Artificial Sequence: Synthetic peptide
ARALKYYDILTGYSEPRTFLDY

SEQ ID NO: 1193 - protein, 107 aa, Artificial Sequence; identical to SEQ ID NO: 1009
  Description of Artificial Sequence: Synthetic polypeptide

SEQ ID NO: 1194 - protein, 9 aa, Artificial Sequence
  Description of Artificial Sequence: Synthetic peptide
QQYDNLPIT

SEQ ID NO: 1195 - protein, 120 aa, Artificial Sequence
  Description of Artificial Sequence: Synthetic polypeptide
EVQLVESGGGLVQPGGSLRLSCAASGFNFSTHWMHWVRQAPGKGLVWVSRINSDGSRRAYATSVKGRFTISRDNAKNTLYLQMDSLRDEDTAVYYCTRDDSSWPHFFDNWGQGTLVTVSS

SEQ ID NO: 1196 - protein, 13 aa, Artificial Sequence
  Description of Artificial Sequence: Synthetic peptide
TRDDSSWPHFFDN

SEQ ID NO: 1197 - protein, 106 aa, Artificial Sequence
  Description of Artificial Sequence: Synthetic polypeptide
DIQMTQSPSSLSASVGDRVTITCRASQSISSYLNWYQQKPGKAPKLLIYVASSLQSGVPSRFSGSGSGTDFTLTISSLQPEDFATYYCQQSYSTRTFGQGTKVEIK

SEQ ID NO: 1198 - protein, 8 aa, Artificial Sequence
  Description of Artificial Sequence: Synthetic peptide
QQSYSTRT

SEQ ID NO: 1199 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSGISDSGVSTYYADSVKGRFTISRDNSKNTLYLQMNSLRAEDTAVYYCANHGDYVGYMDVWGKGTTVTVSS

SEQ ID NO: 1200 - protein, 12 aa, Artificial Sequence
  Description of Artificial Sequence: Synthetic peptide
ANHGDYVGYMDV

SEQ ID NO: 1201 - protein, 108 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPPYTFGQGTKLEIK

SEQ ID NO: 1202 - protein, 10 aa, Artificial Sequence
  Description of Artificial Sequence: Synthetic peptide
QQYDNLPPYT

SEQ ID NO: 1203 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSGMSGSGGITYYADSVKGRFTISRDNSKNTLYLQMNSLRAEDTAVYYCAKDTGSMIVELLGYWGQGTLVTVSS

SEQ ID NO: 1204 - protein, 14 aa, Artificial Sequence
  Description of Artificial Sequence: Synthetic peptide
AKDTGSMIVELLGY

SEQ ID NO: 1205 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYFCQQSYSTPGTFGQGTKVEIK

SEQ ID NO: 1206 - protein, 9 aa, Artificial Sequence
  Description of Artificial Sequence: Synthetic peptide
QQSYSTPGT

SEQ ID NO: 1207 - protein, 127 aa, Artificial Sequence
  Description of Artificial Sequence: Synthetic polypeptide
QVQLVESGGGVVQPGRSLRLSCATSGFTFSSYGLHWVRQAPGKGLEWVALISYDGSDKYYADSVKGRFTISRDTSKNTLFLQMNSLRAEDTAVYYCAKVMGPYCSGGSCYSGYFDYWGQGTLVTVSS

SEQ ID NO: 1208 - protein, 20 aa, Artificial Sequence
  Description of Artificial Sequence: Synthetic peptide
AKVMGPYCSGGSCYSGYFDY

SEQ ID NO: 1209 - protein, 107 aa, Artificial Sequence; identical to SEQ ID NO: 1033
  Description of Artificial Sequence: Synthetic polypeptide

SEQ ID NO: 1210 - protein, 9 aa, Artificial Sequence
  Description of Artificial Sequence: Synthetic peptide
QQRSNWPLT

SEQ ID NO: 1211 - protein, 124 aa, Artificial Sequence
  Description of Artificial Sequence: Synthetic polypeptide
QVQLQESGPGLVKPSQTLSLTCTVSGGSISSGGYYWSWIRQHPGKGLEWIEYIYYSGSTYYNPSLKSRVTISVDTSKNQFSLKLSSVTAADTAVYYCARAQAVGANYAAAFDIWGQGTMVTVSS

SEQ ID NO: 1212 - protein, 16 aa, Artificial Sequence
  Description of Artificial Sequence: Synthetic peptide
ARAQAVGANYAAAFDI

SEQ ID NO: 1213 - protein, 107 aa, Artificial Sequence
  Description of Artificial Sequence: Synthetic polypeptide
  MOD_RES (44)..(44): Any amino acid
DIQMTQSPSSLSASVGDRVTITCQASQDISNYLNWYQQKPGKAXKLLIYDALNLETGVPSRFSGSGSGTDFTFTISSLQPEDIATYYCQQYDNLPITFGQGTRLEIK

SEQ ID NO: 1214 - protein, 9 aa, Artificial Sequence
  Description of Artificial Sequence: Synthetic peptide
QQYDNLPIT

SEQ ID NO: 1215 - protein, 129 aa, Artificial Sequence; identical to SEQ ID NO: 11
  Description of Artificial Sequence: Synthetic polypeptide

SEQ ID NO: 1216 - protein, 23 aa, Artificial Sequence
  Description of Artificial Sequence: Synthetic peptide
ARDSSEVRDHPGHPGRSVGAFDI

SEQ ID NO: 1217 - protein, 110 aa, Artificial Sequence; identical to SEQ ID NO: 12
  Description of Artificial Sequence: Synthetic polypeptide

SEQ ID NO: 1218 - protein, 10 aa, Artificial Sequence
  Description of Artificial Sequence: Synthetic peptide
CSYAGSHTFV

SEQ ID NO: 1219 - protein, 119 aa, Artificial Sequence
  Description of Artificial Sequence: Synthetic polypeptide
  MOD_RES (76)..(76): Any amino acid
QVQLQESGPGLVKPSQTLSLTCTVSGGSVRSGGYYWNWIRQHPGKGLQWIGYVNYSGSTDYNPSLESRLTISVDTXKRQFSLKLTSVTAADTAVYYCASSLVPYYFDSWGQGTLVTVSS

SEQ ID NO: 1220 - protein, 11 aa, Artificial Sequence
  Description of Artificial Sequence: Synthetic peptide
ASSLVPYYFDS

SEQ ID NO: 1221 - protein, 111 aa, Artificial Sequence
  Description of Artificial Sequence: Synthetic polypeptide
QSVLTQPPSVSGAPGQRITISCTGSSSNIGAGFDVHWYQQVPGTAPKLLIYGNNIRPSGVPDRFSGSKSDTSASLAITGLQSEDEADYFCQSYDNSLSDPYVFGTGTKVTV

SEQ ID NO: 1222 - protein, 12 aa, Artificial Sequence
  Description of Artificial Sequence: Synthetic peptide
QSYDNSLSDPYV

SEQ ID NO: 1223 - protein, 115 aa, Artificial Sequence; identical to SEQ ID NO: 19
  Description of Artificial Sequence: Synthetic polypeptide

SEQ ID NO: 1224 - protein, 9 aa, Artificial Sequence
  Description of Artificial Sequence: Synthetic peptide
ARIANYMDV

SEQ ID NO: 1225 - protein, 108 aa, Artificial Sequence; identical to SEQ ID NO: 20
  Description of Artificial Sequence: Synthetic polypeptide

SEQ ID NO: 1226 - protein, 10 aa, Artificial Sequence
  Description of Artificial Sequence: Synthetic peptide
QQYNNWPPLT

SEQ ID NO: 1227 - protein, 124 aa, Artificial Sequence
  Description of Artificial Sequence: Synthetic polypeptide
QVQLVQSGAEVKKPGSSVKVSCKASGGSFSSSAINWVRQAPGQGLEWMGGIIPMFGTANYAQNFQGRVTITADGSTSTAYMELNNLKSEDTAVYYCAIDPSAWYPSRSPRLDSWGQGTLVTVSS

SEQ ID NO: 1228 - protein, 17 aa, Artificial Sequence
  Description of Artificial Sequence: Synthetic peptide
AIDPSAWYPSRSPRLDS

SEQ ID NO: 1229 - protein, 108 aa, Artificial Sequence
  Description of Artificial Sequence: Synthetic polypeptide
QSVLTQPRSVSGSPGQAVTISCTGTSSAVGVYNHLSWYQQHPGKAPKVMIYDIYKRPSGVPDRFSGSKSGNTASLTISGLQSEDEADYYCCSYAGNYTWGGGTKLTVL

SEQ ID NO: 1230 - protein, 11 aa, Artificial Sequence
  Description of Artificial Sequence: Synthetic peptide
SSYISSTTSWV

SEQ ID NO: 1231 - protein, 123 aa, Artificial Sequence
  Description of Artificial Sequence: Synthetic polypeptide
EVQLVQSGAEVKKSGESLKISCKGSGYSFATYWIGWVRQKPGKGLEWMGIIHPSDSDTKYGPSFQGQVTMSADKSISTAYLQWSSLKTSDTAMYYCARGLSGSYSDDEGVEEWGQGTLVTVSS

SEQ ID NO: 1232 - protein, 16 aa, Artificial Sequence
  Description of Artificial Sequence: Synthetic peptide
ARGLSGSYSDDEGVEE

SEQ ID NO: 1233 - protein, 107 aa, Artificial Sequence
  Description of Artificial Sequence: Synthetic polypeptide
EIVLTQSPATLSLSPGERATLSCRASQSLSPYLAWYQQKPGQAPRLLIYDASNRATGIPARFSGSGSGTDFTLTISSLEPEDFAVYYCLQRSYWPLTFGQGTKVEIK

SEQ ID NO: 1234 - protein, 9 aa, Artificial Sequence
  Description of Artificial Sequence: Synthetic peptide
LQRSYWPLT

SEQ ID NO: 1235 - protein, 118 aa, Artificial Sequence; identical to SEQ ID NO: 35
  Description of Artificial Sequence: Synthetic polypeptide

SEQ ID NO: 1236 - protein, 11 aa, Artificial Sequence
  Description of Artificial Sequence: Synthetic peptide
AINTQWDLVPR

SEQ ID NO: 1237 - protein, 108 aa, Artificial Sequence; identical to SEQ ID NO: 36
  Description of Artificial Sequence: Synthetic polypeptide

SEQ ID NO: 1238 - protein, 9 aa, Artificial Sequence
  Description of Artificial Sequence: Synthetic peptide
QQYGFSLYS

SEQ ID NO: 1239 - protein, 124 aa, Artificial Sequence
  Description of Artificial Sequence: Synthetic polypeptide
QVQLQESGPGLVKPSQTLSLTCTVSGGSITSGDYYWNWIRQHPGKGLEWIGYIYYNGGPYNNPSLKSRPTISLDTSKNQFSLKLTSVTAADTAMYYCARGWASSTWCYGCMDVWGQGTTVTVSS

SEQ ID NO: 1240 - protein, 16 aa, Artificial Sequence
  Description of Artificial Sequence: Synthetic peptide
ARGWASSTWCYGCMDV

SEQ ID NO: 1241 - protein, 112 aa, Artificial Sequence
  Description of Artificial Sequence: Synthetic polypeptide
DIVMTQTPLSSPVTLGQPASISCRSSQSLVHSDGNTYLSWLQQRPGQPPRLLIYQISNRFSGVPDRFSGSGAGTDFTLKISRVEAEDVGIYYCTQATQFPHTFGQGTKLEIK

SEQ ID NO: 1242 - protein, 9 aa, Artificial Sequence
  Description of Artificial Sequence: Synthetic peptide
TQATQFPHT

SEQ ID NO: 1243 - protein, 124 aa, Artificial Sequence
  Description of Artificial Sequence: Synthetic polypeptide
QVQLVESGGGVVQPGRSLRLSCAASGFTFSSYGIHWVRQAPGKGLEWVAVISYDGTIKSYAGSVKGRFTISKDNSKNTLYLQMNSLRAEDTAVYYCAKDPFPLAVAGTGYFDYWGQGTLVTVSS

SEQ ID NO: 1244 - protein, 17 aa, Artificial Sequence
  Description of Artificial Sequence: Synthetic peptide
AKDPFPLAVAGTGYFDY

SEQ ID NO: 1245 - protein, 108 aa, Artificial Sequence
  Description of Artificial Sequence: Synthetic polypeptide
SYVLTQPPSVSVAPGQTARITCGGNDIGSKNVHWYQQKPGQAPVLVVYDDSDRPSGIPERFSGSNSGNTATLTISRVEAGDEADYYCQVWDSSGDFWVFGGGTKLTVL

SEQ ID NO: 1246 - protein, 11 aa, Artificial Sequence
  Description of Artificial Sequence: Synthetic peptide
QVWDSSGDFWV

SEQ ID NO: 1247 - protein, 128 aa, Artificial Sequence
  Description of Artificial Sequence: Synthetic polypeptide
QLQLQESGPGLVRPSETLSLTCTVSGVSITSGSYSWGWVRQPPGKGLEWIGTINYSESTYYSPSLKSRVTMSVDTSKNQFSLLLRSVTAADTAVYYCATELYYYDRSGFQHWDGFAIWGQGTMVTVSS

SEQ ID NO: 1248 - protein, 20 aa, Artificial Sequence
  Description of Artificial Sequence: Synthetic peptide
ATELYYYDRSGFQHWDGFAI

SEQ ID NO: 1249 - protein, 108 aa, Artificial Sequence
  Description of Artificial Sequence: Synthetic polypeptide
EIVMTQSPATLSVSPGERVSLSCRASQGVSSNLAWYQQKPGQAPRLLIYGASTRATGIPARISGSGSGTEFTLTISSLQSEDFAIYYCQQYNNWPRRTFGQGTKLEIK

SEQ ID NO: 1250 - protein, 10 aa, Artificial Sequence
  Description of Artificial Sequence: Synthetic peptide
QQYNNWPRRT

SEQ ID NO: 1251 - protein, 120 aa, Artificial Sequence
  Description of Artificial Sequence: Synthetic polypeptide
EVQLVESGGGLVQPGGSLRLSCAASGFTFSNNWMSWVRQAPGKGLEWVANIKQDGSEKYYVDSVKGRFTVSRDNAKNSLYLQMSSLRAEDTAVYYCARDARNFDWYFDLWGRGTLVTVSS

SEQ ID NO: 1252 - protein, 13 aa, Artificial Sequence
  Description of Artificial Sequence: Synthetic peptide
ARDARNFDWYFDL

SEQ ID NO: 1253 - protein, 110 aa, Artificial Sequence
  Description of Artificial Sequence: Synthetic polypeptide
SYVLTQPPSVSVAPGKTARITCGGDDIATKSVHWYQQKPGQAPVLVIYYDSDRPSGIPERFSGSNSGNTATLTINRVEAGDEADYYCQVWDSTSDHRGYVFGTGTKVTVL

SEQ ID NO: 1254 - protein, 13 aa, Artificial Sequence
  Description of Artificial Sequence: Synthetic peptide
QVWDSTSDHRGYV

SEQ ID NO: 1255 - protein, 118 aa, Artificial Sequence; identical to SEQ ID NO: 29
  Description of Artificial Sequence: Synthetic polypeptide

SEQ ID NO: 1256 - protein, 12 aa, Artificial Sequence
  Description of Artificial Sequence: Synthetic peptide
ARDVGDYYGMDV

SEQ ID NO: 1257 - protein, 108 aa, Artificial Sequence
  Description of Artificial Sequence: Synthetic polypeptide
DIQLTQSPSFLFASVGDRVTITCRASQGMSNYLAWYQQKPGKAPNLLIYTASTLQSGVPSRFSGSGFGTEFTFTISSLQPEDFATYYCQLLNSYPQLTFGGGTKVEIK

SEQ ID NO: 1258 - protein, 10 aa, Artificial Sequence
  Description of Artificial Sequence: Synthetic peptide
QLLNSYPQLT

SEQ ID NO: 1259 - protein, 117 aa, Artificial Sequence; identical to SEQ ID NO: 51
  Description of Artificial Sequence: Synthetic polypeptide

SEQ ID NO: 1260 - protein, 11 aa, Artificial Sequence
  Description of Artificial Sequence: Synthetic peptide
ARDLIALGVDV

SEQ ID NO: 1261 - protein, 108 aa, Artificial Sequence; identical to SEQ ID NO: 52
  Description of Artificial Sequence: Synthetic polypeptide

SEQ ID NO: 1262 - protein, 10 aa, Artificial Sequence
  Description of Artificial Sequence: Synthetic peptide
QLLNSYPMCS

SEQ ID NO: 1263 - protein, 116 aa, Artificial Sequence
  Description of Artificial Sequence: Synthetic polypeptide
EVQLVESGGGLVQPGGSLRLSCAASGIIVSRNYMSWVRQAPEKGLEWVSVIYAGGSAFYADSVKGRFTISRDNSKNTLYLQMNGLRAEDTAIYYCARDVARYSDIWGQGTMVTVSS

SEQ ID NO: 1264 - protein, 10 aa, Artificial Sequence
  Description of Artificial Sequence: Synthetic peptide
ARDVARYSDI

SEQ ID NO: 1265 - protein, 107 aa, Artificial Sequence
  Description of Artificial Sequence: Synthetic polypeptide
DIQMTQSPSSLSASVGDRVTITCQASQDINNYLNWYQQKPGKAPKLLIYDASNLETGVPSRFRGSRSGTEFTFTISSLQPEDIATYYCQQCDNLPCSFGQGTKLEIK

SEQ ID NO: 1266 - protein, 9 aa, Artificial Sequence
  Description of Artificial Sequence: Synthetic peptide
QQCDNLPCS

SEQ ID NO: 1267 - protein, 129 aa, Artificial Sequence
  Description of Artificial Sequence: Synthetic polypeptide
EVQLVQSGAEVKKPGESLRISCRGSGYSFTNHWISWVRQTPGKGLEWMGRIDPSDSYTHYSPSFQGHVTFSADKSISTVYLQWSSLKASDTAMYHCARIAPFHDSGSAYYPTQNYMDVWGKGTTVTVSS

SEQ ID NO: 1268 - protein, 22 aa, Artificial Sequence
  Description of Artificial Sequence: Synthetic peptide
ARIAPFHDSGSAYYPTQNYMDV

SEQ ID NO: 1269 - protein, 108 aa, Artificial Sequence
  Description of Artificial Sequence: Synthetic polypeptide
EIVLTQSPGTLSLSPGERATLSCRASQSVSNSYLAWYQQRPGQAPRLLIFGASSKATGIPDRFSGSGSGTDFTLTISRLEPEDFAVYYCQQYGNLILTFGGGTKVEIK

SEQ ID NO: 1270 - protein, 9 aa, Artificial Sequence
  Description of Artificial Sequence: Synthetic peptide
QQYGNLILT

SEQ ID NO: 1271 - protein, 131 aa, Artificial Sequence; identical to SEQ ID NO: 5
  Description of Artificial Sequence: Synthetic polypeptide

SEQ ID NO: 1272 - protein, 25 aa, Artificial Sequence
  Description of Artificial Sequence: Synthetic peptide
AREGDVEGYYDFWSGYSRDRYYFDY

SEQ ID NO: 1273 - protein, 110 aa, Artificial Sequence; identical to SEQ ID NO: 6
  Description of Artificial Sequence: Synthetic polypeptide

SEQ ID NO: 1274 - protein, 10 aa, Artificial Sequence
  Description of Artificial Sequence: Synthetic peptide
NSYTSNNTRV

SEQ ID NO: 1275 - protein, 122 aa, Artificial Sequence
  Description of Artificial Sequence: Synthetic polypeptide
EVQLVESGGGLVKPGGSLRLSCAASRFTFSSAWMSWVRQAPGKGLEWVGRIKTKTDGETTDYAAPVKGRFTISRDDSKNTLYLQMNSLKTEDTAVYYCSTTNDYGDYSPAYWGQGTLVTVSS

SEQ ID NO: 1276 - protein, 13 aa, Artificial Sequence
  Description of Artificial Sequence: Synthetic peptide
STTNDYGDYSPAY

SEQ ID NO: 1277 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSETAFALTISSLQPEDFATYYCQQSYTTPLTFGGGTKVEIK

SEQ ID NO: 1278 - protein, 9 aa, Artificial Sequence
  Description of Artificial Sequence: Synthetic peptide
QQSYTTPLT

SEQ ID NO: 1279 - protein, 129 aa, Artificial Sequence
  Description of Artificial Sequence: Synthetic polypeptide
QVQLVESGGGVVQPGRSLRLSCAASGFIFSSFGMHWVRQAPGKGLEWVAVISYDGTDKYYGDSVKGRFIISRDNSKNTLHLQMNSLRTEDTAVYYCTRAPRGYYNSSGHYYIVDYFDYWGQGALVTVSS

SEQ ID NO: 1280 - protein, 22 aa, Artificial Sequence
  Description of Artificial Sequence: Synthetic peptide
TRAPRGYYNSSGHYYIVDYFDY

SEQ ID NO: 1281 - protein, 107 aa, Artificial Sequence
  Description of Artificial Sequence: Synthetic polypeptide
DIQMTQSPSTLSASVGDRVTITCRASQNINNWLAWYQQKPGKVPKVLISESSSLESGVPSRFSGSGSGTEFTLTIISLQPDDFATYYCQQYQSYPLTFGQGTKTEIK

SEQ ID NO: 1282 - protein, 9 aa, Artificial Sequence
  Description of Artificial Sequence: Synthetic peptide
QQYQSYPLT

SEQ ID NO: 1283 - protein, 131 aa, Artificial Sequence; identical to SEQ ID NO: 7
  Description of Artificial Sequence: Synthetic polypeptide

SEQ ID NO: 1284 - protein, 25 aa, Artificial Sequence
  Description of Artificial Sequence: Synthetic peptide
AREGDVEGYHDSWSGYSRDRYYFDY

SEQ ID NO: 1285 - protein, 110 aa, Artificial Sequence; identical to SEQ ID NO: 8
  Description of Artificial Sequence: Synthetic polypeptide

SEQ ID NO: 1286 - protein, 10 aa, Artificial Sequence
  Description of Artificial Sequence: Synthetic peptide
SSYTNNNTRV

SEQ ID NO: 1287 - protein, 128 aa, Artificial Sequence
  Description of Artificial Sequence: Synthetic polypeptide
EVQLVESGGGLVQPGGSLRLSCTASGFAFSSDDMHWVRQRTGKGLECVSVIGTAGDSYYSDSVKGRFTISRENANNTLYLQMNSLRAGDTAVYYCARGTQSSGWYNGGLKYYYYMDVWGKGTTVTVSS

SEQ ID NO: 1288 - protein, 22 aa, Artificial Sequence
  Description of Artificial Sequence: Synthetic peptide
ARGTQSSGWYNGGLKYYYYMDV

SEQ ID NO: 1289 - protein, 108 aa, Artificial Sequence
  Description of Artificial Sequence: Synthetic polypeptide
DIQMTQSPSSLSASVGDRVTITCRASQSISKYLNWYQQKPGKAPNLLIYAASSLQSGVPSRFSGSGSGTDFTLTISSLQLEDFATYYCQQSYSTPFGTFGGGTKVEIK

SEQ ID NO: 1290 - protein, 10 aa, Artificial Sequence
  Description of Artificial Sequence: Synthetic peptide
QQSYSTPFGT

SEQ ID NO: 1291 - protein, 120 aa, Artificial Sequence
  Description of Artificial Sequence: Synthetic polypeptide
QVQLQESGPGLVKPSETLSLTCTVSGGSVSSGTYYWSWIRQPPGKGLEWIGYIYYSGNTNYNPSLKSRVTISLDTSKNQFSLKLNSVTAADTAVYYCARESGVGGTFDYWGQGTLVTVSS

SEQ ID NO: 1292 - protein, 12 aa, Artificial Sequence
  Description of Artificial Sequence: Synthetic peptide
ARESGVGGTFDY

SEQ ID NO: 1293 - protein, 109 aa, Artificial Sequence
  Description of Artificial Sequence: Synthetic polypeptide
EIVLTQSPGTLSLSPGERATLSCRASQTVSSSYLAWYQQKPGQAPRLLIFGASRRATGIPVRFSGGGSGTDFTLTISRLEAEDFAVYYCQQYGSSPSYTFGQGTKLEIK

SEQ ID NO: 1294 - protein, 10 aa, Artificial Sequence
  Description of Artificial Sequence: Synthetic peptide
QQYGSSPSYT

SEQ ID NO: 1295 - protein, 123 aa, Artificial Sequence
  Description of Artificial Sequence: Synthetic polypeptide
QVQLVQSGAEVKKPGASVKVSCKASGYTFTNYYMHWVRQAPGQGLEWMGIINPDGGSTTYAQKFQGRVTMTRDTSTSTVYMELRSLRSEDTAMYYCARDHDFIPTITRGFDLWGQGTLVTVSS

SEQ ID NO: 1296 - protein, 16 aa, Artificial Sequence
  Description of Artificial Sequence: Synthetic peptide
ARDHDFIPTITRGFDL

SEQ ID NO: 1297 - protein, 108 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQQSGISLLTFGGGTKVEIK

SEQ ID NO: 1298 - protein, 9 aa, Artificial Sequence
  Description of Artificial Sequence: Synthetic peptide
QQSGISLLT

SEQ ID NO: 1299 - protein, 118 aa, Artificial Sequence
  Description of Artificial Sequence: Synthetic polypeptide
QVQLQQWGAGLLKPSETLSLTCVVYGGSFSAYYWSWIRQPPGKGLEWIGEINHSGSTNYKSSLQSRVTISVDTSKNQFSLKLSSVTAADTAVYYCARETGTYGTFDHWGQGTPVTVSS

SEQ ID NO: 1300 - protein, 12 aa, Artificial Sequence
  Description of Artificial Sequence: Synthetic peptide
ARETGTYGTFDH

SEQ ID NO: 1301 - protein, 107 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQQYAFSVWTFGQGTKVEI

SEQ ID NO: 1302 - protein, 9 aa, Artificial Sequence
  Description of Artificial Sequence: Synthetic peptide
QQYAFSVWT

SEQ ID NO: 1303 - protein, 121 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGGTYYNPSLKSRVTISVDTSKNQFSLRLSSVTAADTAVYYCAREEQQLAPWFDPWGQGTLVTVSS

SEQ ID NO: 1304 - protein, 13 aa, Artificial Sequence
  Description of Artificial Sequence: Synthetic peptide
AREEQQLAPWFDP

SEQ ID NO: 1305 - protein, 111 aa, Artificial Sequence
  Description of Artificial Sequence: Synthetic polypeptide
QSVLTQPPSVSGAPGQRVTISCTGSSSNIGAGYDVHWYQQLPGTAPKLLIYDNINRPSGVPDRFSGSKSGTSASLAITGLQAEDEADYYCQSFDSSLSAYVFAPGTKVTVL

SEQ ID NO: 1306 - protein, 11 aa, Artificial Sequence
  Description of Artificial Sequence: Synthetic peptide
QSFDSSLSAYV

SEQ ID NO: 1307 - protein, 115 aa, Artificial Sequence; identical to SEQ ID NO: 19
  Description of Artificial Sequence: Synthetic polypeptide

SEQ ID NO: 1308 - protein, 9 aa, Artificial Sequence
  Description of Artificial Sequence: Synthetic peptide
ARIANYMDV

SEQ ID NO: 1309 - protein, 108 aa, Artificial Sequence; identical to SEQ ID NO: 20
  Description of Artificial Sequence: Synthetic polypeptide

SEQ ID NO: 1310 - protein, 10 aa, Artificial Sequence
  Description of Artificial Sequence: Synthetic peptide
QQYNNWPPLT

SEQ ID NO: 1311 - protein, 131 aa, Artificial Sequence; identical to SEQ ID NO: 1
  Description of Artificial Sequence: Synthetic polypeptide

SEQ ID NO: 1312 - protein, 25 aa, Artificial Sequence
  Description of Artificial Sequence: Synthetic peptide
AREGDVEGLHDFWSGYSRDRYYFDY

SEQ ID NO: 1313 - protein, 110 aa, Artificial Sequence
  Description of Artificial Sequence: Synthetic polypeptide
QSVLTQPASVSGSPGQSIIISCTGTSGDIGGYNYVSWYQQHPGKAPKLMIYDVSFRPSGVSNRFSGSKSDNTASLTISGLQAEDEADYYCSSFTGNNTRVFGTGTKVTVL

SEQ ID NO: 1314 - protein, 10 aa, Artificial Sequence
  Description of Artificial Sequence: Synthetic peptide
SSFTGNNTRV

SEQ ID NO: 1315 - protein, 125 aa, Artificial Sequence; identical to SEQ ID NO: 27
  Description of Artificial Sequence: Synthetic polypeptide

SEQ ID NO: 1316 - protein, 17 aa, Artificial Sequence
  Description of Artificial Sequence: Synthetic peptide
ARVSTTVTTYLVGGFDI

SEQ ID NO: 1317 - protein, 107 aa, Artificial Sequence
  Description of Artificial Sequence: Synthetic polypeptide
DIQMTQSPSSLSASVGDRVTITCQASQDITNYLNWYQQKPGKAPKLLLYDASNLETGVPSRFSGSGSGTDFTFTISSLQPEDIATYYCQQYDNLPWTFGQGTKVEIK

SEQ ID NO: 1318 - protein, 9 aa, Artificial Sequence
  Description of Artificial Sequence: Synthetic peptide
QQYDNLPWT

SEQ ID NO: 1319 - protein, 118 aa, Artificial Sequence
  Description of Artificial Sequence: Synthetic polypeptide
QVQLQQWGAGLLKPSETLSLTCTVYGGSFSGYYWSWIRQPPGKGLEWIGEINHSGTTNYNPSLKSRVTISLDTSKNQFSLKLSSVTAADTAVYYCARVRWLRGETDYWGQGTLVTVSS

SEQ ID NO: 1320 - protein, 12 aa, Artificial Sequence
  Description of Artificial Sequence: Synthetic peptide
ARVRWLRGETDY

SEQ ID NO: 1321 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQRVFGGGTKLTVL

SEQ ID NO: 1322 - protein, 10 aa, Artificial Sequence
  Description of Artificial Sequence: Synthetic peptide
QSYDSSNQRV

SEQ ID NO: 1323 - protein, 121 aa, Artificial Sequence
  Description of Artificial Sequence: Synthetic polypeptide
  MOD_RES (45)..(45): Any amino acid
  MOD_RES (59)..(59): Any amino acid
EVQLLESGGGLVQPGGSLRLSCAASGLTFSRYAMSWVRQAPGKGXEWFSGIGGDRDRSXYADSAKGRFTISRDNSKSTLYLQMNSLRTEDTAVYYCAKDVVSWPHYYFDFWGQGTLVTVSS

SEQ ID NO: 1324 - protein, 14 aa, Artificial Sequence
  Description of Artificial Sequence: Synthetic peptide
AKDVVSWPHYYFDF

SEQ ID NO: 1325 - protein, 107 aa, Artificial Sequence
  Description of Artificial Sequence: Synthetic polypeptide
DIQMTQSPSSLSASVGDRVTITCQASQDINNYLNWYQQKPGKAPKLLIYDASNLEAGVPSRFSGRGSGTDFTFTISSLQPEDIATYYCQQYDNLLITFGQGTRLDIK

SEQ ID NO: 1326 - protein, 9 aa, Artificial Sequence
  Description of Artificial Sequence: Synthetic peptide
QQYDNLLIT

SEQ ID NO: 1327 - protein, 121 aa, Artificial Sequence
  Description of Artificial Sequence: Synthetic polypeptide
EVQLVQSGAEVKKPGESLKISCKGSGYSFISNWIGWVRQMPGKGLEWMGIIYPYDSDTRYSPSFQGQITISADKSISTAYLQWSSLKASDTAMYYCATSIAVSGTYAFDVWGQGTVVTVSS

SEQ ID NO: 1328 - protein, 14 aa, Artificial Sequence
  Description of Artificial Sequence: Synthetic peptide
ATSIAVSGTYAFDV

SEQ ID NO: 1329 - protein, 111 aa, Artificial Sequence
  Description of Artificial Sequence: Synthetic polypeptide
QSVLTQPPSVSGAPGQRVTISCTGSSSNIGAYGVHWYQQFPGTAPKLLIYGDSSRPSGVPDRFSASKSGTSASLAITGLQAEDEADYYCQAYDSGLSGNFVFGTGTKVTVL

SEQ ID NO: 1330 - protein, 12 aa, Artificial Sequence
  Description of Artificial Sequence: Synthetic peptide
QAYDSGLSGNFV

SEQ ID NO: 1331 - protein, 132 aa, Artificial Sequence
  Description of Artificial Sequence: Synthetic polypeptide
QVQLVESGGGVVQPGRSLRLSCAASGFTFSSYAMYWVRQAPGKGLEWVAVISFDGRNIYYADSVKGRFSISRENSKSTLFLQMNSLRLDDTAMYYCARDCGPAQPPLVEADDYFYFYGMDVWGQGTTVTVSS

SEQ ID NO: 1332 - protein, 25 aa, Artificial Sequence
  Description of Artificial Sequence: Synthetic peptide
ARDCGPAQPPLVEADDYFYFYGMDV

SEQ ID NO: 1333 - protein, 108 aa, Artificial Sequence
  Description of Artificial Sequence: Synthetic polypeptide
SYVLTQPPSVSVSPGQTARITCSGDAFPKQYGYWYQQKPGQAPVLVIYKDSERPSGIPERFSGSSSGTTVTLTISGVQAEDEADYYCQSADSSGTRRVFGGGTKLTVL

SEQ ID NO: 1334 - protein, 11 aa, Artificial Sequence
  Description of Artificial Sequence: Synthetic peptide
QSADSSGTRRV

SEQ ID NO: 1335 - protein, 122 aa, Artificial Sequence
  Description of Artificial Sequence: Synthetic polypeptide
EVQLVQSGAEVKKPGESLRISCKGFGYSFTNYWIGWVRQMPGKGLEWMGIIYPGDSDTKYSPSFQGQVTMSADKSTNTAYLHWSSLKASDTAMYYCARRGYNYGNYYYLDVWGKGTPVTVSS

SEQ ID NO: 1336 - protein, 15 aa, Artificial Sequence
  Description of Artificial Sequence: Synthetic peptide
ARRGYNYGNYYYLDV

SEQ ID NO: 1337 - protein, 108 aa, Artificial Sequence
  Description of Artificial Sequence: Synthetic polypeptide
DIQMTQSPSSLSASVGDSVTITCRASQSISTYLNWYQQKPGKAPKLLIYDASSLQSGVPSRFSGSGSGTDFTLTLSSLQPEDFATYYCQQSFSTLALTFGGGTKVEIK

SEQ ID NO: 1338 - protein, 10 aa, Artificial Sequence
  Description of Artificial Sequence: Synthetic peptide
QQSFSTLALT

SEQ ID NO: 1339 - protein, 121 aa, Artificial Sequence; identical to SEQ ID NO: 53
  Description of Artificial Sequence: Synthetic polypeptide

SEQ ID NO: 1340 - protein, 15 aa, Artificial Sequence
  Description of Artificial Sequence: Synthetic peptide
GVCAGDCYAASVFDY

SEQ ID NO: 1341 - protein, 107 aa, Artificial Sequence; identical to SEQ ID NO: 54
  Description of Artificial Sequence: Synthetic polypeptide

SEQ ID NO: 1342 - protein, 9 aa, Artificial Sequence
  Description of Artificial Sequence: Synthetic peptide
QQYDNLPLT

SEQ ID NO: 1343 - protein, 127 aa, Artificial Sequence
  Description of Artificial Sequence: Synthetic polypeptide
QVQLVQSGAEVKKPGASVKVSCKASGYNFTSYYMYWVRQAPGQGLEWMGIINPSGGSTSYAQKFQGRVTMTRDTSTSTVYMELSSLRSEDTAVYYCARDRLKQPNPGLRMYNWFAPWGQGTLVTVSS

SEQ ID NO: 1344 - protein, 20 aa, Artificial Sequence
  Description of Artificial Sequence: Synthetic peptide
ARDRLKQPNPGLRMYNWFAP

SEQ ID NO: 1345 - protein, 116 aa, Artificial Sequence
  Description of Artificial Sequence: Synthetic polypeptide
QSVLTQPPSASASLGASVTLTCTLSSGYSNYKVDWYQQRPGKGPRFVMRVGTGGIVGSKGDGIPDRFSVLGSGLNRYLTIKNIQEEDESDYHCGADHGSGSNFVWVFGGGTKLTVL

SEQ ID NO: 1346 - protein, 13 aa, Artificial Sequence
  Description of Artificial Sequence: Synthetic peptide
GADHGSGSNFVWV

SEQ ID NO: 1347 - protein, 123 aa, Artificial Sequence
  Description of Artificial Sequence: Synthetic polypeptide
EVQLLESGGGLVQPGGSLRLSCAASGFSFSDYAMYWVRQAPGKGLEWVSTISGSGANTYYADSVKGRFTISRDNSKNTLSLQMNSLRGEDTAVYYCAIPFTIFGVVPDWCFDFWGRGTLVTVS

SEQ ID NO: 1348 - protein, 17 aa, Artificial Sequence
  Description of Artificial Sequence: Synthetic peptide
AIPFTIFGVVPDWCFDF

SEQ ID NO: 1349 - protein, 109 aa, Artificial Sequence
  Description of Artificial Sequence: Synthetic polypeptide
QSVLTQPRSVSGSPGQSVTISCTGTSSDVGAYNYVSWYQQHPGKAPKLMIYNVSERPSGVPDRFSGSKSGNTASLTISGLQADDEADYYCCSYAGNFWVFGTGTKLTVL

SEQ ID NO: 1350 - protein, 9 aa, Artificial Sequence
  Description of Artificial Sequence: Synthetic peptide
CSYAGNFWV

SEQ ID NO: 1351 - protein, 131 aa, Artificial Sequence; identical to SEQ ID NO: 9
  Description of Artificial Sequence: Synthetic polypeptide

SEQ ID NO: 1352 - protein, 25 aa, Artificial Sequence
  Description of Artificial Sequence: Synthetic peptide
AREGDVEGYYDFWSGYSRDRYYFDY

SEQ ID NO: 1353 - protein, 110 aa, Artificial Sequence; identical to SEQ ID NO: 10
  Description of Artificial Sequence: Synthetic polypeptide

SEQ ID NO: 1354 - protein, 10 aa, Artificial Sequence
  Description of Artificial Sequence: Synthetic peptide
SSYTSSSARV

SEQ ID NO: 1355 - protein, 122 aa, Artificial Sequence
  Description of Artificial Sequence: Synthetic polypeptide
EVQLVESGGDLVQPGGSLRLSCAASGFTFTTYSMSWVRQAPGKGLEWISYINSGSANIHYADSVKGRFTVSRDNAKNSLYLQMNSLRDEDTAVYYCARGDCLSSSCYSLDYWGQGALVTVSS

SEQ ID NO: 1356 - protein, 15 aa, Artificial Sequence
  Description of Artificial Sequence: Synthetic peptide
ARGDCLSSSCYSLDY

SEQ ID NO: 1357 - protein, 107 aa, Artificial Sequence
  Description of Artificial Sequence: Synthetic polypeptide
DIQMTQSPSSLSASVGDRVTITCRASQSITSYLSWYLQKPGEAPKLLIYAASILQSGVPSRFGGNGSGTDFTLTISSLQPEDFATFYCQQTYRSPLTFGGGTRVEIK

SEQ ID NO: 1358 - protein, 9 aa, Artificial Sequence
  Description of Artificial Sequence: Synthetic peptide
QQTYRSPLT

SEQ ID NO: 1359 - protein, 130 aa, Artificial Sequence
  Description of Artificial Sequence: Synthetic polypeptide
QVQLVESGGGVVQPGRSLRLSCAASGFSFRIFGMNWVRQAPGKGLDWVAGISHDGSDKYFADSVKGRFTISRDNSKNTLYLQMNSLRADDTAVYYCARDMEVDYYDRSGHYHVFHAFDIWGQGTVVTVSS

SEQ ID NO: 1360 - protein, 23 aa, Artificial Sequence
  Description of Artificial Sequence: Synthetic peptide
ARDMEVDYYDRSGHYHVFHAFDI

SEQ ID NO: 1361 - protein, 113 aa, Artificial Sequence; identical to SEQ ID NO: 32
  Description of Artificial Sequence: Synthetic polypeptide

SEQ ID NO: 1362 - protein, 9 aa, Artificial Sequence
  Description of Artificial Sequence: Synthetic peptide
QQYYSIPRS

SEQ ID NO: 1363 - protein, 122 aa, Artificial Sequence; identical to SEQ ID NO: 21
  Description of Artificial Sequence: Synthetic polypeptide

SEQ ID NO: 1364 - protein, 15 aa, Artificial Sequence
  Description of Artificial Sequence: Synthetic peptide
ARERGYYGGKTPPFL

SEQ ID NO: 1365 - protein, 111 aa, Artificial Sequence; identical to SEQ ID NO: 22
  Description of Artificial Sequence: Synthetic polypeptide

SEQ ID NO: 1366 - protein, 10 aa, Artificial Sequence
  Description of Artificial Sequence: Synthetic peptide
QSYDSSNYWV

SEQ ID NO: 1367 - protein, 119 aa, Artificial Sequence
  Description of Artificial Sequence: Synthetic polypeptide
EVQLVESGGNLVQPGGSLRLSCSASGFTFSNYAIHWVRQAPGKGLEYVSLVSSNGDTTYYAGSVKGRFTISRDNSKNTLYLQMSSLRAEDTAVYYCVRGDMVAGYFDYWGQGTLVTVSS

SEQ ID NO: 1368 - protein, 12 aa, Artificial Sequence
  Description of Artificial Sequence: Synthetic peptide
VRGDMVAGYFDY

SEQ ID NO: 1369 - protein, 109 aa, Artificial Sequence
  Description of Artificial Sequence: Synthetic polypeptide
SYVLTQPPSVSVAPGQTARITCGGDEIGSKNVHWYQQKPGQAPVLVVYDDSDRPSGIPERFSGSNSANTASLTISRLESGDEADYYCQVWDSSSDHHWVFGGGTKLTVL

SEQ ID NO: 1370 - protein, 12 aa, Artificial Sequence
  Description of Artificial Sequence: Synthetic peptide
QVWDSSSDHHWV

SEQ ID NO: 1371 - protein, 127 aa, Artificial Sequence
  Description of Artificial Sequence: Synthetic polypeptide
QVQLVQSGAEVKKPGASVKVSCKASGYIFSRYDMHWVRQAPGQRLEWMGWINAGNGNTRYSQKFQGRVTITRDTSATTVYMDLTSLRSEDTAVYYCARDPSYCSDERCSRRDWFDPWGQGTLVTVSS

SEQ ID NO: 1372 - protein, 20 aa, Artificial Sequence
  Description of Artificial Sequence: Synthetic peptide
ARDPSYCSDERCSRRDWFDP

SEQ ID NO: 1373 - protein, 109 aa, Artificial Sequence
  Description of Artificial Sequence: Synthetic polypeptide
SYVLTQPPSVSVAPGQTARIACGGDTIGSKNVHWYQQKPGQAPVLVVYDDSDRPSGIPERFSGSNSGNTATLSISRVEAGDEADYFCQVWDSGSDHFWVFGGRDQADRP

SEQ ID NO: 1374 - protein, 12 aa, Artificial Sequence
  Description of Artificial Sequence: Synthetic peptide
QVWDSGSDHFWV

SEQ ID NO: 1375 - protein, 121 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVSISVDTSKNQFSLKLSSVTAADTAVYYCARGVGFGELGFDPWGQGTLVTVSS

SEQ ID NO: 1376 - protein, 13 aa, Artificial Sequence
  Description of Artificial Sequence: Synthetic peptide
ARGVGFGELGFDP

SEQ ID NO: 1377 - protein, 108 aa, Artificial Sequence
  Description of Artificial Sequence: Synthetic polypeptide
DIQLTQSPSFLSASVGDRVTITCRASQGISSYLAWYQQKPGKAPKLLIYGASTLQSGVPSRFSGSGSGTEFTLTISSLQPEDFATYYCQQLNSYPPITFGQGTRLEIK

SEQ ID NO: 1378 - protein, 10 aa, Artificial Sequence
  Description of Artificial Sequence: Synthetic peptide
QQLNSYPPIT

SEQ ID NO: 1379 - protein, 115 aa, Artificial Sequence
  Description of Artificial Sequence: Synthetic polypeptide
EVQLVESGGGLVKPGGSLTLSCAASGFSFFSYNMNWVRQAPGKGLEWVSSIGSTTKYIYYADSVKGRFTISRDNAKNLLYLQMNSLRAEDTAVYYCVRERYGDNWGQGTLVTVSS

SEQ ID NO: 1380 - protein, 8 aa, Artificial Sequence
  Description of Artificial Sequence: Synthetic peptide
VRERYGDN

SEQ ID NO: 1381 - protein, 109 aa, Artificial Sequence
  Description of Artificial Sequence: Synthetic polypeptide
QSVLTQSPSASASLGASVKLTCTLSSGHSSYAIAWHQQQPEKGPRFLMSLNSDGSHSKGDGIPDRFSGSSSGPERYLTISSLQSEDEADYYCQTWGLWVFGGGTKLTVL

SEQ ID NO: 1382 - protein, 7 aa, Artificial Sequence
  Description of Artificial Sequence: Synthetic peptide
QTWGLWV

SEQ ID NO: 1383 - protein, 119 aa, Artificial Sequence
  Description of Artificial Sequence: Synthetic polypeptide
QVQLQESGPGLVRPSQILSLTCTVSGGSISSGGYYWSWIRQHPGKGLEWIGYIYYSGSTYYNPSLKSRVSISVDTSKNQFSLKLSSVTAADTAVFYCATFTVAGHFLFWGQGTLVTVSS

SEQ ID NO: 1384 - protein, 11 aa, Artificial Sequence
  Description of Artificial Sequence: Synthetic peptide
ATFTVAGHFLF

SEQ ID NO: 1385 - protein, 106 aa, Artificial Sequence
  Description of Artificial Sequence: Synthetic polypeptide
DIQMTQSPSSLSASVGDRVTITCQASQDSTNHLNWYQQKPGKAPKLLIYDASNLETGVPSRFSGSGSGTDFTFTISSLQPEDIATYYCQHYDDLPSFGPGTKVDFK

SEQ ID NO: 1386 - protein, 8 aa, Artificial Sequence
  Description of Artificial Sequence: Synthetic peptide
QHYDDLPS

SEQ ID NO: 1387 - protein, 130 aa, Artificial Sequence; identical to SEQ ID NO: 13
  Description of Artificial Sequence: Synthetic polypeptide

SEQ ID NO: 1388 - protein, 23 aa, Artificial Sequence
  Description of Artificial Sequence: Synthetic peptide
ARGPLFHKLVYDSWSGYHDGFDI

SEQ ID NO: 1389 - protein, 110 aa, Artificial Sequence
  Description of Artificial Sequence: Synthetic polypeptide
QSVLTQPASVSGSPGQSITISCTGTSSDVGAYKFVSWYQQHPGKAPQLIIYEVSNRPSGVSNRFSGSKSGNTASLTISGLQAEDEADYYCSSYTNASTWVFGGGTELTVL

SEQ ID NO: 1390 - protein, 10 aa, Artificial Sequence
  Description of Artificial Sequence: Synthetic peptide
SSYTNASTWV

SEQ ID NO: 1391 - protein, 117 aa, Artificial Sequence
  Description of Artificial Sequence: Synthetic polypeptide
EVQLVESGGGLIQPGGSLRLSCAASGITVSSNYMSWVRQAPGKGLEWVSIIYAGGSSFYADSVKGRFTISRDNSKNTLYLQMNSLRAEDTAVYYCARDLIALGVDVWGQGTTVTVSS

SEQ ID NO: 1392 - protein, 11 aa, Artificial Sequence
  Description of Artificial Sequence: Synthetic peptide
ARDLIALGVDV

SEQ ID NO: 1393 - protein, 108 aa, Artificial Sequence
  Description of Artificial Sequence: Synthetic polypeptide
DIQLTQSPSFLSASVGDRVTITCRASQGISTYLAWYQQKPGKAPKLLIYAASTLQSGVPSRFSGSGSGTEFTLTISSLQPEDFATYYCQLLDSYPMCSFGQGTKLEIK

SEQ ID NO: 1394 - protein, 10 aa, Artificial Sequence
  Description of Artificial Sequence: Synthetic peptide
QLLDSYPMCS

SEQ ID NO: 1395 - protein, 129 aa, Artificial Sequence
  Description of Artificial Sequence: Synthetic polypeptide
QVQLVQSGAEVKKPGASVKVSCKASGYTFTDYYIHCVRQAPGQGLEWMGMINPGGGSTSYAQKFQGRVTMTRDTSTTTVYMEMSSLRSEDTAVYYCVRGENSFDSSGNEQYNNYAMDVWGQGTTVTVSS

SEQ ID NO: 1396 - protein, 22 aa, Artificial Sequence
  Description of Artificial Sequence: Synthetic peptide
VRGENSFDSSGNEQYNNYAMDV

SEQ ID NO: 1397 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASNLQSGVPSRFSGSGSGTDFTLTISSLQPEDFATYYCQQYNSYPPTFGGGTKVEIK

SEQ ID NO: 1398 - protein, 9 aa, Artificial Sequence
  Description of Artificial Sequence: Synthetic peptide
QQYNSYPPT

SEQ ID NO: 1399 - protein, 121 aa, Artificial Sequence
  Description of Artificial Sequence: Synthetic polypeptide
QVQLQESGPGLVKPSETLSLTCAVSGGSISSYYWSWIRQPPGKGLEWIGYIDTSGSTNYNPSLKSRVTLSVDTSKNQFSLNLSSVTAADTAVYFCGVCAGDCYSASVFDYWGQGTLVTVSS

SEQ ID NO: 1400 - protein, 15 aa, Artificial Sequence
  Description of Artificial Sequence: Synthetic peptide
GVCAGDCYSASVFDY

SEQ ID NO: 1401 - protein, 107 aa, Artificial Sequence; identical to SEQ ID NO: 54
  Description of Artificial Sequence: Synthetic polypeptide

SEQ ID NO: 1402 - protein, 9 aa, Artificial Sequence
  Description of Artificial Sequence: Synthetic peptide
QQYDNLPLT

SEQ ID NO: 1403 - protein, 127 aa, Artificial Sequence
  Description of Artificial Sequence: Synthetic polypeptide
QVQLVESGGGVVQPGRSLRLSCAASGFTFGHYGMHWVRQAPGKGLEWVAVILYDGSNTYYADSVKGRFTISRDNSKNTLYLQMNSLRTEDTAVYYCAKAPSPYCGGGDCYSSGFDPWGQGSLVTVSS

SEQ ID NO: 1404 - protein, 20 aa, Artificial Sequence
  Description of Artificial Sequence: Synthetic peptide
AKAPSPYCGGGDCYSSGFDP

SEQ ID NO: 1405 - protein, 107 aa, Artificial Sequence
  Description of Artificial Sequence: Synthetic polypeptide
DIQMTQSPSSLSASVGDRVTITCQASQDITDYLNWYQQKPGKAPKLLIYDASNLETGVPSRFSGSGTGTDFSFTISSLQPEDFATYYCQQYANLPLTFGGGTKVEIK

SEQ ID NO: 1406 - protein, 9 aa, Artificial Sequence
  Description of Artificial Sequence: Synthetic peptide
QQYANLPLT

SEQ ID NO: 1407 - protein, 122 aa, Artificial Sequence
  Description of Artificial Sequence: Synthetic polypeptide
QLQLQESGPGLVKPSETLSLTCTVSSGSISSSSYYWGWIRQPPGKGLEWIGSIFSSGGAHYNPSLKSRVTISVDTSRNQFSLNLTSVTAADTAVYYCARHPAVAGDEYFQHWGQGTLVTVSS

SEQ ID NO: 1408 - protein, 14 aa, Artificial Sequence
  Description of Artificial Sequence: Synthetic peptide
ARHPAVAGDEYFQH

SEQ ID NO: 1409 - protein, 110 aa, Artificial Sequence
  Description of Artificial Sequence: Synthetic polypeptide
SYVLTQPPSVSVAPGKTASITCGGDNIGSKNVHWYQQKPGQAPVLVIYYDSDRPSGIPERFSGSNSGNTATLTISRVEAGDEADYYCQVWDSTTDLPHYVFGAGTRVTVL

SEQ ID NO: 1410 - protein, 13 aa, Artificial Sequence
  Description of Artificial Sequence: Synthetic peptide
QVWDSTTDLPHYV

SEQ ID NO: 1411 - protein, 121 aa, Artificial Sequence
  Description of Artificial Sequence: Synthetic polypeptide
EVQLVQSGAEVTKTGESLKISCKSSGYSFISNWIGWVRQMPGKGLEWVAIIYPGDSDTRYSPSFQGQVTISADTSISTAYLQWSSLKASDTAMYYCARLLGGTYAADFDYWGQGTLVTVSS

SEQ ID NO: 1412 - protein, 14 aa, Artificial Sequence
  Description of Artificial Sequence: Synthetic peptide
ARLLGGTYAADFDY

SEQ ID NO: 1413 - protein, 110 aa, Artificial Sequence
  Description of Artificial Sequence: Synthetic polypeptide
QSVLTQPPSASGSPGQSVTISCTGTSSDVGGHNYVSWYRHHPGKAPKLMIYEVSKRPSGVPDRFSGSKSGNTASLTVSGLQAEDEADYYCGSYAGSHKWVFGGGTKLTVL

SEQ ID NO: 1414 - protein, 10 aa, Artificial Sequence
  Description of Artificial Sequence: Synthetic peptide
GSYAGSHKWV

SEQ ID NO: 1415 - protein, 118 aa, Artificial Sequence; identical to SEQ ID NO: 23
  Description of Artificial Sequence: Synthetic polypeptide

SEQ ID NO: 1416 - protein, 11 aa, Artificial Sequence
  Description of Artificial Sequence: Synthetic peptide
VRRASSTNFEF

SEQ ID NO: 1417 - protein, 108 aa, Artificial Sequence
  Description of Artificial Sequence: Synthetic polypeptide
SYVLTQPPSVSVAPGQTATITCGGNNIGSKTVHWYQQKPGQAPVVVVYDDSDRPSGIPERFSGSKSGSTATLTITRVEAGDEADYYCQVWDSTSDHYVFGTGTKVAVI

SEQ ID NO: 1418 - protein, 11 aa, Artificial Sequence
  Description of Artificial Sequence: Synthetic peptide
QVWDSTSDHYV

SEQ ID NO: 1419 - protein, 123 aa, Artificial Sequence
  Description of Artificial Sequence: Synthetic polypeptide
EVQLVQSGAEVKKPGESLKISCKGSGYTFTKYWIAWVRQMPGKGLEWMGFIYPADSDTRYSPSFEGQVTISADKSTSTAYLQWSSLKASDTAIYYCARPGGKGEHYHGPIDYWGQGTLVTVSS

SEQ ID NO: 1420 - protein, 16 aa, Artificial Sequence
  Description of Artificial Sequence: Synthetic peptide
ARPGGKGEHYHGPIDY

SEQ ID NO: 1421 - protein, 107 aa, Artificial Sequence
  Description of Artificial Sequence: Synthetic polypeptide
DIQMTQSPSSLSASVGDRVTITCQASQDISDYLNWYQQKPGKAPKLLIYDASNLETGVPSRFSGSGSGTDFTFTISSLQPKDIATYYCQQYNNFPPSFGQGTKLEIK

SEQ ID NO: 1422 - protein, 9 aa, Artificial Sequence
  Description of Artificial Sequence: Synthetic peptide
QQYNNFPPS

SEQ ID NO: 1423 - protein, 130 aa, Artificial Sequence
  Description of Artificial Sequence: Synthetic polypeptide
QVQLVESGGGVVQPGRSLRLSCAASGFTFRTYAMHWVRQAPGKGLEWVAVILSDGNNKYYADSVKGRFTISRDNSKNTLYLQMNSLRAEDTAIFYCAREQEANYYDISGYYHWGESLGYWGQGTLVTVPS

SEQ ID NO: 1424 - protein, 23 aa, Artificial Sequence
  Description of Artificial Sequence: Synthetic peptide
AREQEANYYDISGYYHWGESLGY

SEQ ID NO: 1425 - protein, 109 aa, Artificial Sequence; identical to SEQ ID NO: 50
  Description of Artificial Sequence: Synthetic polypeptide

SEQ ID NO: 1426 - protein, 11 aa, Artificial Sequence
  Description of Artificial Sequence: Synthetic peptide
QKVNSYPPGLT

SEQ ID NO: 1427 - protein, 121 aa, Artificial Sequence
  Description of Artificial Sequence: Synthetic polypeptide
QVQLQESGPGLVKPSQTLSLSCTVSGGSISSGGYYWSWIRQHPGKGLEWIGYIYYSGSTYYNPSLKSRITMSVDTSKNQFSLKLSSVTAADTAVYYCARDYVTGRGAFDIWGQGTMVIVSS

SEQ ID NO: 1428 - protein, 13 aa, Artificial Sequence
  Description of Artificial Sequence: Synthetic peptide
ARDYVTGRGAFDI

SEQ ID NO: 1429 - protein, 106 aa, Artificial Sequence
  Description of Artificial Sequence: Synthetic polypeptide
DIQMTQSPSSLSASVGDRVTITCQASRDISNYLNWYQQRPGEAPKLLIYDASNLETGVPSRFSGSGSGTDFTFTISSLQPEDIATYYCQQYDTFPCTFGQGTKLEI

SEQ ID NO: 1430 - protein, 9 aa, Artificial Sequence
  Description of Artificial Sequence: Synthetic peptide
QQYDTFPCT

SEQ ID NO: 1431 - protein, 127 aa, Artificial Sequence
  Description of Artificial Sequence: Synthetic polypeptide
EVQLLESGGGLVQPGGSLRLSCVVSGFTFKNYAMSWVRQAPGKGLEWVSGINGYNDNTYYAASVKGRFTISRDNSKNTLYLQMNSLRLEDTAVYFCAKRGYHYDSSAYFSPYYFDYWGQGTLVTVSS

SEQ ID NO: 1432 - protein, 20 aa, Artificial Sequence
  Description of Artificial Sequence: Synthetic peptide
AKRGYHYDSSAYFSPYYFDY

SEQ ID NO: 1433 - protein, 107 aa, Artificial Sequence
  Description of Artificial Sequence: Synthetic polypeptide
DIQMTQSPSSLFASIGDRVTITCQGSQDISNHLNWYQQKPGKAPKLLIYDASNLETGVPSRFSGNGSGTDFTFTIASLQPEDIATYYCQQYDTLPPFFGGGTKVEIK

SEQ ID NO: 1434 - protein, 9 aa, Artificial Sequence
  Description of Artificial Sequence: Synthetic peptide
QQYDTLPPF

SEQ ID NO: 1435 - protein, 121 aa, Artificial Sequence
  Description of Artificial Sequence: Synthetic polypeptide
QVQLVQSGAEVKKPGSSVKVSCKASGDTYNTYAISWVRQAPGQGLEYMGGITLVFGTTNYAQKFQGRLTITTDESTTTFYMDLISLRSEDTAIYYCARAGVAYGDYVPDYWGQGTLVIVSS

SEQ ID NO: 1436 - protein, 14 aa, Artificial Sequence
  Description of Artificial Sequence: Synthetic peptide
ARAGVAYGDYVPDY

SEQ ID NO: 1437 - protein, 109 aa, Artificial Sequence
  Description of Artificial Sequence: Synthetic polypeptide
EIVLTQSPGTLSLSPGERATLSCRASQSISSNYLAWYQQNPGQAPRLLIYGASSRATGIPDRFSGSGSGTDFTLTISRLEPEDFAVYYCQQYGNSPPWTFGQGTKVEIK

SEQ ID NO: 1438 - protein, 10 aa, Artificial Sequence
  Description of Artificial Sequence: Synthetic peptide
QQYGNSPPWT

SEQ ID NO: 1439 - protein, 121 aa, Artificial Sequence; identical to SEQ ID NO: 43
  Description of Artificial Sequence: Synthetic polypeptide

SEQ ID NO: 1440 - protein, 15 aa, Artificial Sequence
  Description of Artificial Sequence: Synthetic peptide
ARLKQQLVGFGWFDP

SEQ ID NO: 1441 - protein, 110 aa, Artificial Sequence; identical to SEQ ID NO: 44
  Description of Artificial Sequence: Synthetic polypeptide

SEQ ID NO: 1442 - protein, 10 aa, Artificial Sequence
  Description of Artificial Sequence: Synthetic peptide
QSYDHRLHWV

SEQ ID NO: 1443 - protein, 128 aa, Artificial Sequence
  Description of Artificial Sequence: Synthetic polypeptide
EVQLVESGGGLVQPGGSLRLSCAASGFTFSSYCMNWVRQAPGKGLEWVSYISSSSNIIYYADSVKGRFTISRDNAKNSLYLQMNSLRAEDTAVYYCARDLRTYNDFWSGHGPYFFDYWGQGTLVTVSS

SEQ ID NO: 1444 - protein, 21 aa, Artificial Sequence
  Description of Artificial Sequence: Synthetic peptide
ARDLRTYNDFWSGHGPYFFDY

SEQ ID NO: 1445 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSETEFTLTISSLQPDDFATYYCQQYNHYSYTFGQGTKLEIK

SEQ ID NO: 1446 - protein, 9 aa, Artificial Sequence
  Description of Artificial Sequence: Synthetic peptide
QQYNHYSYT

SEQ ID NO: 1447 - protein, 121 aa, Artificial Sequence
  Description of Artificial Sequence: Synthetic polypeptide
QVQLQESGPGLVKPSETLSLTCTVSGGSISTFYWNWIRQPPGKGLEWIGHIYYSGSTNYNPSLKSRVTISLDTSENQFSLRMSSVTGADTAVYYCARGVVQLNYDYGMDVWGQGTTVTVSS

SEQ ID NO: 1448 - protein, 15 aa, Artificial Sequence
  Description of Artificial Sequence: Synthetic peptide
ARGVVQLNYDYGMDV

SEQ ID NO: 1449 - protein, 109 aa, Artificial Sequence
  Description of Artificial Sequence: Synthetic polypeptide
SYVLTQPPSVSVAPGKTARITCGGDNIGSKSVHWYQQRPGQAPVLVIYYDSDRPSGIPERFSGSNSGNTATLTISRVEAGDEADYYCQVWDNGSDHPVLFGGGTKLTVL

SEQ ID NO: 1450 - protein, 12 aa, Artificial Sequence
  Description of Artificial Sequence: Synthetic peptide
QVWDNGSDHPVL

SEQ ID NO: 1451 - protein, 124 aa, Artificial Sequence; identical to SEQ ID NO: 33
  Description of Artificial Sequence: Synthetic polypeptide

SEQ ID NO: 1452 - protein, 17 aa, Artificial Sequence
  Description of Artificial Sequence: Synthetic peptide
ARDHSSSSFVYYYYMDV

SEQ ID NO: 1453 - protein, 109 aa, Artificial Sequence
  Description of Artificial Sequence: Synthetic polypeptide
QSVLTQPRSVSGSPGQSVTISCTGTSSDIGGYNYVSWYQQHPDKAPKFIIFDVSKRPSGVPDRFSGSKSGNTASLTISGLQAEDEADYYCCSYAGPYPYVFGTGTKVTV

SEQ ID NO: 1454 - protein, 10 aa, Artificial Sequence
  Description of Artificial Sequence: Synthetic peptide
CSYAGPYPYV

SEQ ID NO: 1455 - protein, 127 aa, Artificial Sequence
  Description of Artificial Sequence: Synthetic polypeptide
EVQLVESGGGLVQPGGSLRLSCAASGFTFSSHSMSWVRQAPVKGLEWVSYISGRSSTIYYADSVKGRFTISRDNAKNSLYLQMNSLRDEDTAVYYCARAMAPTYNDFYSGPDVFDIWGQGTMVTVSS

SEQ ID NO: 1456 - protein, 20 aa, Artificial Sequence
  Description of Artificial Sequence: Synthetic peptide
ARAMAPTYNDFYSGPDVFDI

SEQ ID NO: 1457 - protein, 107 aa, Artificial Sequence
  Description of Artificial Sequence: Synthetic polypeptide
DIQMTQSPSTLSASVGDRVTITCRASQTISSWLAWYQQKPGKAPKVLIYKASSLETGVPSRFSGSGSGTEFTLTIINLQPDDFATYYCQQYNSYSVTFGGGTKVEIK

SEQ ID NO: 1458 - protein, 9 aa, Artificial Sequence
  Description of Artificial Sequence: Synthetic peptide
QQYNSYSVT

SEQ ID NO: 1459 - protein, 116 aa, Artificial Sequence
  Description of Artificial Sequence: Synthetic polypeptide
QVQLQESGPGLVKPSGTLSLTCAVSGASITSSNWWSWVRQPPGEGLEWIGEIYHNGNTEYNPSLKSRVTISVDKSKNQFSLKLSSVTAADTAVYYCARVSGMFDYWGQGSLVTVSS

SEQ ID NO: 1460 - protein, 9 aa, Artificial Sequence
  Description of Artificial Sequence: Synthetic peptide
ARVSGMFDY

SEQ ID NO: 1461 - protein, 106 aa, Artificial Sequence
  Description of Artificial Sequence: Synthetic polypeptide
DIQMTQSPSSLSASVGDRVTITCRASQGISNSLAWYQQKPGKAPKLLLYAASTLESGVPSRFSGSGSGTEYTLTISSLQPEDFATYYCQQYYSIRTFGQGTRVDIK

SEQ ID NO: 1462 - protein, 8 aa, Artificial Sequence
  Description of Artificial Sequence: Synthetic peptide
QQYYSIRT

SEQ ID NO: 1463 - protein, 132 aa, Artificial Sequence
  Description of Artificial Sequence: Synthetic polypeptide
QVQLVESGGGVVQPGRSLRLSCAASGFTFSSYGMHWVRQAPGKGLEWVATIWYDGSEKYYADSVKGRFTISRDNSKNTLYLQMNSLRAEDTAVFYCARDVTPYYYGSGSYYKLGETTHPDYWGQGTLVTVSS

SEQ ID NO: 1464 - protein, 25 aa, Artificial Sequence
  Description of Artificial Sequence: Synthetic peptide
ARDVTPYYYGSGSYYKLGETTHPDY

SEQ ID NO: 1465 - protein, 106 aa, Artificial Sequence
  Description of Artificial Sequence: Synthetic polypeptide
DIQMTQSPSTLSASVGDRVTITCRASQSIGVWLAWYQQKPGKAPKLLIYKASSLETGVPSRFSGSGSGTEFTLTINSLQPDDFATYHCQQYNSFPLTFGQGTKLEI

SEQ ID NO: 1466 - protein, 9 aa, Artificial Sequence
  Description of Artificial Sequence: Synthetic peptide
QQYNSFPLT

SEQ ID NO: 1467 - protein, 131 aa, Artificial Sequence; identical to SEQ ID NO: 3
  Description of Artificial Sequence: Synthetic polypeptide

SEQ ID NO: 1468 - protein, 25 aa, Artificial Sequence
  Description of Artificial Sequence: Synthetic peptide
AREGDVEGFSDLWSGYSRDRYYFDY

SEQ ID NO: 1469 - protein, 110 aa, Artificial Sequence
  Description of Artificial Sequence: Synthetic polypeptide
QSVLTQPASVSGSPGQSITFSCTGTSSDVGGYNYVSWYQQYPGKAPKLLIYDVTNRPSGVSDRFSGSKSGNTASLTISGLQAEDEADYYCSSFTSSNTRVFGTGTKVTVL

SEQ ID NO: 1470 - protein, 10 aa, Artificial Sequence
  Description of Artificial Sequence: Synthetic peptide
SSFTSSNTRV

SEQ ID NO: 1471 - protein, 125 aa, Artificial Sequence; identical to SEQ ID NO: 45
  Description of Artificial Sequence: Synthetic polypeptide

SEQ ID NO: 1472 - protein, 18 aa, Artificial Sequence
  Description of Artificial Sequence: Synthetic peptide
ARASTSTTSWSDALSLGS

SEQ ID NO: 1473 - protein, 113 aa, Artificial Sequence; identical to SEQ ID NO: 46
  Description of Artificial Sequence: Synthetic polypeptide

SEQ ID NO: 1474 - protein, 13 aa, Artificial Sequence
  Description of Artificial Sequence: Synthetic peptide
QSWDNGLSASGVV

SEQ ID NO: 1475 - protein, 120 aa, Artificial Sequence
  Description of Artificial Sequence: Synthetic polypeptide
QVQLQESGPGLVKPSGTLSLTCAVSGGSISNNNWWSWVRQPPGKGLEWIGEIFHSGTITYNPSLKSRVTISVDKSKNQFSLKLKSVTAADTAVYYCARAWIQPHNWFDPWGQGILVTVSS

SEQ ID NO: 1476 - protein, 13 aa, Artificial Sequence
  Description of Artificial Sequence: Synthetic peptide
ARAWIQPHNWFDP

SEQ ID NO: 1477 - protein, 108 aa, Artificial Sequence
  Description of Artificial Sequence: Synthetic polypeptide
EIVLTQSPGTLSLSPGERATLSCRASQTVSSSYLAWYQQKPGQAPRLLIYGASSRATGIPDRFSGSGSGTDFTLTISRLEPEDFAVYYCQQYGSSPRTFGQGTKLEIK

SEQ ID NO: 1478 - protein, 9 aa, Artificial Sequence
  Description of Artificial Sequence: Synthetic peptide
QQYGSSPRT

SEQ ID NO: 1479 - protein, 123 aa, Artificial Sequence
  Description of Artificial Sequence: Synthetic polypeptide
QVQLVESGGGVVQPGRSLRLSCEASGFTFSHYGIHWVRQAPGKGLEWVAVMSYDGSDEYYADSVKGRFTISRDNSRNTVYLQMNSLRTDDTAVYYCAKVGAPYYYYYYGMDVWGQGTPVTVSS

SEQ ID NO: 1480 - protein, 16 aa, Artificial Sequence
  Description of Artificial Sequence: Synthetic peptide
AKVGAPYYYYYYGMDV

SEQ ID NO: 1481 - protein, 111 aa, Artificial Sequence
  Description of Artificial Sequence: Synthetic polypeptide
QSVLTQPASVSGSPGQSITISCTGTSSDVGAYNYVSWYQQYPGKAPKLMIYEVSDRPSGVSNRFSGSKSGNTASLTISGLQAEDEADYYCSSYISSTTSWVFGGGTKLTVL

SEQ ID NO: 1482 - protein, 11 aa, Artificial Sequence
  Description of Artificial Sequence: Synthetic peptide
SSYISSTTSWV

SEQ ID NO: 1483 - protein, 130 aa, Artificial Sequence; identical to SEQ ID NO: 17
  Description of Artificial Sequence: Synthetic polypeptide

SEQ ID NO: 1484 - protein, 23 aa, Artificial Sequence
  Description of Artificial Sequence: Synthetic peptide
ARGPLFHKLVYDSWTGYHDGFDI

SEQ ID NO: 1485 - protein, 110 aa, Artificial Sequence
  Description of Artificial Sequence: Synthetic polypeptide
QSVLTQPASVSGSPGQSITISCTGTSSDVGGYNYVSWYQHYPGKAPKLMIYEVTHRPSGVSNRFSGSKSGNTASLTISGLQAEDEADYYCSSSTNSSTWVFGGGTKMTVL

SEQ ID NO: 1486 - protein, 10 aa, Artificial Sequence
  Description of Artificial Sequence: Synthetic peptide
SSSTNSSTWV

SEQ ID NO: 1487 - protein, 120 aa, Artificial Sequence
  Description of Artificial Sequence: Synthetic polypeptide
QVQLVESGGGVVQPGRSLRLSCAASGFAFSNYGMHWVRQAPGKGLDWVAVIWYDGSNKYYADSVKGRFTISRDNSKNTLYLQMNSLRAENTAVYYCARDPMIVVVEMDYWGQGTLVTVSS

SEQ ID NO: 1488 - protein, 13 aa, Artificial Sequence
  Description of Artificial Sequence: Synthetic peptide
ARDPMIVVVEMDY

SEQ ID NO: 1489 - protein, 112 aa, Artificial Sequence
  Description of Artificial Sequence: Synthetic polypeptide
DVVMTQSPLSLPVTLGQPASISCRSGQSLVHSDGNTYLNWFQQRPGQSPRRLIYRVSNRDSGVPDRFSGSGSGTDFTLKISRVEADDVGVYYCMQGTHWPYTFGQGTKLEIK

SEQ ID NO: 1490 - protein, 9 aa, Artificial Sequence
  Description of Artificial Sequence: Synthetic peptide
MQGTHWPYT

SEQ ID NO: 1491 - protein, 130 aa, Artificial Sequence
  Description of Artificial Sequence: Synthetic polypeptide
QVQLVESGGGVVQTGRSVRLSCAASGFTFTNYGMHWVRQAPGKGLEWVAVIWYDGSNKYYADSVRGRFTISRDNSKNTLFLQMNSLRAEDTAVYYCARDFIPEDLIVVDVTGGAYGMDVWGQGTTVTVSS

SEQ ID NO: 1492 - protein, 23 aa, Artificial Sequence
  Description of Artificial Sequence: Synthetic peptide
ARDFIPEDLIVVDVTGGAYGMDV

SEQ ID NO: 1493 - protein, 110 aa, Artificial Sequence
  Description of Artificial Sequence: Synthetic polypeptide
QSVLTQPASVSGSPGQSITISCTGSSSDIGGYNFVSWYQQHPGKAPKLMIYDVSNRPPGVSYRFSGSKSGNTASLTISGLQAEDEADYYCNSYTGSTTPLFGGGTKLTVL

SEQ ID NO: 1494 - protein, 10 aa, Artificial Sequence
  Description of Artificial Sequence: Synthetic peptide
NSYTGSTTPL

SEQ ID NO: 1495 - protein, 122 aa, Artificial Sequence
  Description of Artificial Sequence: Synthetic polypeptide
EVQLVESGGTLVQPGGSLRLSCSASGFTFSTYTMHWVRQAPGKGLEYVSGISITGDIAYYADSVKGRFTISRDNSKNTLYFQMSSLRPEDTALYYCVKDRDSSTWYDAFDIWGQGTMVTVSS

SEQ ID NO: 1496 - protein, 15 aa, Artificial Sequence
  Description of Artificial Sequence: Synthetic peptide
VKDRDSSTWYDAFDI

SEQ ID NO: 1497 - protein, 107 aa, Artificial Sequence
  Description of Artificial Sequence: Synthetic polypeptide
DIQMTQSPSSLSASVGDRVTITCRARQSITSYLNWYQQKPGKAPKLLIYAASSLQSGVPSRFSGSGSGTDFTLTISSLQPEDFATYYCQQSYSTPWTFGQGTKVEIK

SEQ ID NO: 1498 - protein, 9 aa, Artificial Sequence
  Description of Artificial Sequence: Synthetic peptide
QQSYSTPWT

SEQ ID NO: 1499 - protein, 125 aa, Artificial Sequence
  Description of Artificial Sequence: Synthetic polypeptide
QLQLQESGPGLVKPSETLSLTCTVSGGSMSSSNHYWGWIRQPPGKGLEWIGSIYYSGSTFHNPSLMSRVTISVDTSKSQFSLKLTSVTAADTAVYYCARHDLPPYSSGWSYFDNWGQGTLVTVSS

SEQ ID NO: 1500 - protein, 17 aa, Artificial Sequence
  Description of Artificial Sequence: Synthetic peptide
ARHDLPPYSSGWSYFDN

SEQ ID NO: 1501 - protein, 109 aa, Artificial Sequence
  Description of Artificial Sequence: Synthetic polypeptide
QSVLTQPPSVSAAPGQKVTISCSGSTSNIGSNSVSWYQQLPGTAPKLLIYDNNKRPSGIPDRFSGSKSGTSATLGITGLQTGDEADYYCGSWDSSLREVFGTGTKVSVL

SEQ ID NO: 1502 - protein, 10 aa, Artificial Sequence
  Description of Artificial Sequence: Synthetic peptide
GSWDSSLREV

SEQ ID NO: 1503 - protein, 122 aa, Artificial Sequence
  Description of Artificial Sequence: Synthetic polypeptide
QVQLVQSGAGVRKPGASVKVSCKASGYTFTGYYMHWVRQAPGQGLEWMGWINPNNGDTGYAQKFQGWVTMTRDTSISTAYMELSRLTSADTAVYYCVRGAVVYGTAGWFDPWGQGTLVTVSS

SEQ ID NO: 1504 - protein, 15 aa, Artificial Sequence
  Description of Artificial Sequence: Synthetic peptide
VRGAVVYGTAGWFDP

SEQ ID NO: 1505 - protein, 106 aa, Artificial Sequence
  Description of Artificial Sequence: Synthetic polypeptide
SYVLTQPPSVSVAPGQTARITCGADNIGSKNVHWYQQKAAQAPVLVVYDDSDRPSGIPERFSGSNSGNTATLTISRVEAGDEADYYCQVWDSYSNWVFGGGAKLTV

SEQ ID NO: 1506 - protein, 10 aa, Artificial Sequence
  Description of Artificial Sequence: Synthetic peptide
QVWDSYSNWV

SEQ ID NO: 1507 - protein, 120 aa, Artificial Sequence
  Description of Artificial Sequence: Synthetic polypeptide
EVQLVQSGAEVKKPGESLKISCKGPAYSFTNYWIGWVRQMPGKGLEWMGVIYPGDSETRYSPSFQGQVTISADKSISTAYLQWNSLSASDTAIYYCARQFCGGHCPFDFWGQGTLVTVSS

SEQ ID NO: 1508 - protein, 13 aa, Artificial Sequence
  Description of Artificial Sequence: Synthetic peptide
ARQFCGGHCPFDF

SEQ ID NO: 1509 - protein, 111 aa, Artificial Sequence
  Description of Artificial Sequence: Synthetic polypeptide
NFMLTQPHSVSESPGKTVTISCTGNSGSIASNYVQWYQQRPDSAPTTVIFEDDQRPSGVPDRFSGSIDSSSNSASLTISGLRTEDEADYYCQSYDSNNLWVFGGGTKLTVL

SEQ ID NO: 1510 - protein, 10 aa, Artificial Sequence
  Description of Artificial Sequence: Synthetic peptide
QSYDSNNLWV

SEQ ID NO: 1511 - protein, 130 aa, Artificial Sequence; identical to SEQ ID NO: 25
  Description of Artificial Sequence: Synthetic polypeptide

SEQ ID NO: 1512 - protein, 23 aa, Artificial Sequence
  Description of Artificial Sequence: Synthetic peptide
AKAVHYGGNSDRRFSEPSAPFDY

SEQ ID NO: 1513 - protein, 111 aa, Artificial Sequence
  Description of Artificial Sequence: Synthetic polypeptide
QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSSTPYVFGTGTKVTVL

SEQ ID NO: 1514 - protein, 11 aa, Artificial Sequence
  Description of Artificial Sequence: Synthetic peptide
CSYAGSSTPYV

SEQ ID NO: 1515 - protein, 122 aa, Artificial Sequence
  Description of Artificial Sequence: Synthetic polypeptide
QLQLQESGPGLVKPSETLSLTCSVSGGSIIRSSYYWGWIRQPPGKGLEWIGSIYYSGSTYYNPSLKSRVTISVDTSKNQFSLKLSSVTAADTAVYYCARRRYLDWSSPFEYWGQGTLVTVSS

SEQ ID NO: 1516 - protein, 14 aa, Artificial Sequence
  Description of Artificial Sequence: Synthetic peptide
ARRRYLDWSSPFEY

SEQ ID NO: 1517 - protein, 108 aa, Artificial Sequence
  Description of Artificial Sequence: Synthetic polypeptide
SYVLTQPPSVSVAPGQTARITCGGNNIGSKRVHWYQQKPGQAPVLVVYDDSDRPSGIPERFSGSNSGNTATLTISRVEAGDEADYSCQVWDSSSDLQVFGGGTKLTVL

SEQ ID NO: 1518 - protein, 11 aa, Artificial Sequence
  Description of Artificial Sequence: Synthetic peptide
QVWDSSSDLQV

SEQ ID NO: 1519 - protein, 118 aa, Artificial Sequence
  Description of Artificial Sequence: Synthetic polypeptide
QVQLQQWGAGLLKPSETLSLTCAVYGGSFSDYYWSWIRQPPGKGLEWIGENNHSGKTNYNPSLESRVTISVDTSKNQFSLKLTSVTAADTAVYYCARESGTYATFDYWGQGTLVTVSS

SEQ ID NO: 1520 - protein, 12 aa, Artificial Sequence
  Description of Artificial Sequence: Synthetic peptide
ARESGTYATFDY

SEQ ID NO: 1521 - protein, 108 aa, Artificial Sequence
  Description of Artificial Sequence: Synthetic polypeptide
EIVLTQSPGTLSLSPGERVTLSCRASQNVSSAYLAWYQQKPGQAPRLLIYGASSRATGIPDRFSGSGSGTDFTLTISRLEPEDFAVYYCQQYGYTIWTFGQGTKVEIK

SEQ ID NO: 1522 - protein, 9 aa, Artificial Sequence
  Description of Artificial Sequence: Synthetic peptide
QQYGYTIWT

SEQ ID NO: 1523 - protein, 126 aa, Artificial Sequence
  Description of Artificial Sequence: Synthetic polypeptide
EVQLVQSGAEVKKPGESLKISCKGSGYSFTSYWIGWVRQMPGRGLEWMGIIYPGDSDTKYSPSFQGQVTISADKSISTAYLQWSSLKASDTAMYYCARRNLITADGPFYYYGMDVWGQGTTVTVSS

SEQ ID NO: 1524 - protein, 19 aa, Artificial Sequence
  Description of Artificial Sequence: Synthetic peptide
ARRNLITADGPFYYYGMDV

SEQ ID NO: 1525 - protein, 107 aa, Artificial Sequence
  Description of Artificial Sequence: Synthetic polypeptide
AIQLTQSPSSLSASVGDRVTITCRASQGISGALAWYQQKPGNAPDLLIYDASGLESGVPSRFSGSGSGTDFTLTISSLQPEDFATYYCQQFNSYSSTFGQGTRLEIK

SEQ ID NO: 1526 - protein, 9 aa, Artificial Sequence
  Description of Artificial Sequence: Synthetic peptide
QQFNSYSST

SEQ ID NO: 1527 - protein, 130 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVFYCARDRGGHDFWSGYGFYYYYGMDVWGQGTTVTVSS

SEQ ID NO: 1528 - protein, 23 aa, Artificial Sequence
  Description of Artificial Sequence: Synthetic peptide
ARDRGGHDFWSGYGFYYYYGMDV

SEQ ID NO: 1529 - protein, 107 aa, Artificial Sequence
  Description of Artificial Sequence: Synthetic polypeptide
DIQMTQSPSSLSASVGDRVTITCRASQGISNYLAWYQQRPGKVPKLLIFAASTLQSGVPSRFSGSGSGTDFTLTISSLQPEDVATYYCQKYNSAPRTFGQGTKVEIK

SEQ ID NO: 1530 - protein, 9 aa, Artificial Sequence
  Description of Artificial Sequence: Synthetic peptide
QKYNSAPRT

SEQ ID NO: 1531 - protein, 118 aa, Artificial Sequence
  Description of Artificial Sequence: Synthetic polypeptide
EVQLVETGGGLIQPGGSLRLSCAASEFTVSSNYMSWVRQAPGKGLEWVSLIYSGGSTYYADSVKGRFTISRDNSKNTLYLQMNSLRAEDTAVYYCARVLPFGDYFDYWGQGTLVTVSS

SEQ ID NO: 1532 - protein, 12 aa, Artificial Sequence
  Description of Artificial Sequence: Synthetic peptide
ARVLPFGDYFDY

SEQ ID NO: 1533 - protein, 111 aa, Artificial Sequence
  Description of Artificial Sequence: Synthetic polypeptide
  MOD_RES (110)..(110): Any amino acid
QSVLTQPPSVSGAPGQRVTISCTGSSSNIGAGYDVHWCQQLPGTAPKLLIYGYSNRPSGVPDRFSGSKSGTSASLAITGLQAEDEADYYCQSYDINLSAWVFGGGTRLTXL

SEQ ID NO: 1534 - protein, 11 aa, Artificial Sequence
  Description of Artificial Sequence: Synthetic peptide
QSYDINLSAWV

SEQ ID NO: 1535 - protein, 129 aa, Artificial Sequence [sequence omitted]

SEQ ID NO: 1536 - protein, 23 aa, Artificial Sequence
  Description of Artificial Sequence: Synthetic peptide
ARDSSEVRDHPGHPGRSVGAFDI

SEQ ID NO: 1537 - protein, 110 aa, Artificial Sequence
  Description of Artificial Sequence: Synthetic polypeptide
QSVLTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL

SEQ ID NO: 1538 - protein, 10 aa, Artificial Sequence
  Description of Artificial Sequence: Synthetic peptide
CSYAGASTFV

SEQ ID NO: 1539 - protein, 115 aa, Artificial Sequence; identical to SEQ ID NO: 19
  Description of Artificial Sequence: Synthetic polypeptide

SEQ ID NO: 1540 - protein, 9 aa, Artificial Sequence
  Description of Artificial Sequence: Synthetic peptide
ARIANYMDV

SEQ ID NO: 1541 - protein, 108 aa, Artificial Sequence; identical to SEQ ID NO: 20
  Description of Artificial Sequence: Synthetic polypeptide

SEQ ID NO: 1542 - protein, 10 aa, Artificial Sequence
  Description of Artificial Sequence: Synthetic peptide
QQYNNWPPLT

SEQ ID NO: 1543 - protein, 127 aa, Artificial Sequence
  Description of Artificial Sequence: Synthetic polypeptide
EVQLVESGGGLVQPGGSLRLSCVASGFTFSSYWMHWVRQVPGKGPVWVSHINSEGSSTNYADSVRGRFTISRDNAKDTLYLQMNNLRAEDTAVYYCARPTAVAAAGNYFYYYGMDVWGQGTTVTVSS

SEQ ID NO: 1544 - protein, 20 aa, Artificial Sequence
  Description of Artificial Sequence: Synthetic peptide
ARPTAVAAAGNYFYYYGMDV

SEQ ID NO: 1545 - protein, 110 aa, Artificial Sequence
  Description of Artificial Sequence: Synthetic polypeptide
QSVLTQPASVSGSPGQSITISCTGTSSDVGYYNFVSWYQQHPGKAPKLMIYEVSNRPSGVSNRFSGSKSGNTASLIISGLQAEDEADYYCSSYRSSSTLVFGGGTKLTVL

SEQ ID NO: 1546 - protein, 10 aa, Artificial Sequence
  Description of Artificial Sequence: Synthetic peptide
SSYRSSSTLV

SEQ ID NO: 1547 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYIYTSGSTNYNPSLKSRVTISVDTSKNQFSLKLSSVTAADTAVYYCARHSWLRGMADYWGQGTLVTVSS

SEQ ID NO: 1548 - protein, 12 aa, Artificial Sequence
  Description of Artificial Sequence: Synthetic peptide
ARHSWLRGMADY

SEQ ID NO: 1549 - protein, 110 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSIWVFGGGTKLTVL

SEQ ID NO: 1550 - protein, 9 aa, Artificial Sequence
  Description of Artificial Sequence: Synthetic peptide
QSYDSSIWV

SEQ ID NO: 1551 - protein, 120 aa, Artificial Sequence
  Description of Artificial Sequence: Synthetic polypeptide
QVQLQESGPGLVKPSGTLSLTCAVSGGSISSSNWWSWVRQPPGKGLEWIGEIYHSGTTNYNPSLKSRVTISVDKSKNQFSLKLSSVTAADTAVYYCARTWIQPHNWFDPWGQGTLVTVSS

SEQ ID NO: 1552 - protein, 13 aa, Artificial Sequence
  Description of Artificial Sequence: Synthetic peptide
ARTWIQPHNWFDP

SEQ ID NO: 1553 - protein, 108 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCQQYNSYPLFTFGPGTKVDIK

SEQ ID NO: 1554 - protein, 10 aa, Artificial Sequence
  Description of Artificial Sequence: Synthetic peptide
QQYNSYPLFT

SEQ ID NO: 1555 - protein, 126 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREAARRYDFWSGLNWFDPWGQGTLVTVSS

SEQ ID NO: 1556 - protein, 19 aa, Artificial Sequence
  Description of Artificial Sequence: Synthetic peptide
AREAARRYDFWSGLNWFDP

SEQ ID NO: 1557 - protein, 113 aa, Artificial Sequence
  Description of Artificial Sequence: Synthetic polypeptide
  MOD_RES (15)..(15): Any amino acid
DIVMTQSPDSLAVSXGERATINCKSSQSVLYSSNNKNYLAWYQQKPGQPPKLLIYWASTRESGVPDRFSGSGSGTDFTLTISSLQAEDVAVYYCQQYYSTMLTFGGGTKVEIK

SEQ ID NO: 1558 - protein, 9 aa, Artificial Sequence
  Description of Artificial Sequence: Synthetic peptide
QQYYSTMLT

SEQ ID NO: 1559 - protein, 131 aa, Artificial Sequence; identical to SEQ ID NO: 317
  Description of Artificial Sequence: Synthetic polypeptide

SEQ ID NO: 1560 - protein, 25 aa, Artificial Sequence
  Description of Artificial Sequence: Synthetic peptide
AREGEVEGYNDFWSGYSRDRYYFDY

SEQ ID NO: 1561 - protein, 110 aa, Artificial Sequence
  Description of Artificial Sequence: Synthetic polypeptide
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 1562 - protein, 10 aa, Artificial Sequence
  Description of Artificial Sequence: Synthetic peptide
SSYTSSSTRV

SEQ ID NO: 1563 - protein, 117 aa, Artificial Sequence
  Description of Artificial Sequence: Synthetic polypeptide
EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCARDYGDFYFDYWGQGTLVTVSS

SEQ ID NO: 1564 - protein, 11 aa, Artificial Sequence
  Description of Artificial Sequence: Synthetic peptide
ARDYGDFYFDY

SEQ ID NO: 1565 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPRTFGQGTKVEIK

SEQ ID NO: 1566 - protein, 9 aa, Artificial Sequence
  Description of Artificial Sequence: Synthetic peptide
QQYNNWPRT

SEQ ID NO: 1567 - protein, 121 aa, Artificial Sequence; identical to SEQ ID NO: 41
  Description of Artificial Sequence: Synthetic polypeptide

SEQ ID NO: 1568 - protein, 15 aa, Artificial Sequence
  Description of Artificial Sequence: Synthetic peptide
ARLKQQLVGFGWFDP

SEQ ID NO: 1569 - protein, 110 aa, Artificial Sequence; identical to SEQ ID NO: 42
  Description of Artificial Sequence: Synthetic polypeptide

SEQ ID NO: 1570 - protein, 10 aa, Artificial Sequence
  Description of Artificial Sequence: Synthetic peptide
QSYDHSLNWV

SEQ ID NO: 1571 - protein, 127 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVPASYGDDDYYYYYGMDVWGQGTTVTVSS

SEQ ID NO: 1572 - protein, 20 aa, Artificial Sequence
  Description of Artificial Sequence: Synthetic peptide
ARVPASYGDDDYYYYYGMDV

SEQ ID NO: 1573 - protein, 108 aa, Artificial Sequence
  Description of Artificial Sequence: Synthetic polypeptide
SYVLTQPPSVSVSPGQTARITCSGDALPKQYAYWYQQKPGQAPVLVIYKDSERPSGIPERFSGSSSGTTVTLTISGVQAEDEADYYCQSADSSGTLWVFGGGTKLTVL

SEQ ID NO: 1574 - protein, 11 aa, Artificial Sequence
  Description of Artificial Sequence: Synthetic peptide
QSADSSGTLWV

SEQ ID NO: 1575 - protein, 122 aa, Artificial Sequence; identical to SEQ ID NO: 37
  Description of Artificial Sequence: Synthetic polypeptide

SEQ ID NO: 1576 - protein, 13 aa, Artificial Sequence
  Description of Artificial Sequence: Synthetic peptide
TTTNDYGDYSPAY

SEQ ID NO: 1577 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTAFTLTISSLQPEDFATYYCQQSYSTPLTFGGGTKVEIK

SEQ ID NO: 1578 - protein, 9 aa, Artificial Sequence
  Description of Artificial Sequence: Synthetic peptide
QQSYSTPLT

SEQ ID NO: 1579 - protein, 122 aa, Artificial Sequence
  Description of Artificial Sequence: Synthetic polypeptide
QVQLQESGPGLVKPSETLSLTCTVSGGSISSYYWSWIRQPPGKGLEWIGYIYYSRSTNYNPSLKSRVTISVDTSKNQFSLKLSSVTAADTAVYYCARHDTIFGVGQYYFDYWGQGTLVTVSS

SEQ ID NO: 1580 - protein, 16 aa, Artificial Sequence
  Description of Artificial Sequence: Synthetic peptide
ARHDTIFGVGQYYFDY

SEQ ID NO: 1581 - protein, 110 aa, Artificial Sequence
  Description of Artificial Sequence: Synthetic polypeptide
QSVLTQPASVSGSPGQSVTISCTGTSSDVGSYNLVSWYQQHPGKAPKVMIYEDSKRPSGVSNRFSGSKSGNTASLTISGLQAEDEADYYCCSYAGSSTWVFGGGTKLTVL

SEQ ID NO: 1582 - protein, 10 aa, Artificial Sequence
  Description of Artificial Sequence: Synthetic peptide
CSYAGSSTWV

SEQ ID NO: 1583 - protein, 121 aa, Artificial Sequence
  Description of Artificial Sequence: Synthetic polypeptide
QVQLVQSGAEVKKPGASVKVSCKASGYTFTSHYMHWVRQAPGQGLEWMGIINPSGGGTSYAQKFQGRVTMTRDTSMSTVYMELSSLRSEDTAVYYCASSSSTPDYYGMDVWGQGTTVTVSS

SEQ ID NO: 1584 - protein, 14 aa, Artificial Sequence
  Description of Artificial Sequence: Synthetic peptide
ASSSSTPDYYGMDV

SEQ ID NO: 1585 - protein, 108 aa, Artificial Sequence
  Description of Artificial Sequence: Synthetic polypeptide
DIQLTQSPSFLSASVGDRVTITCRASQGISSYLAWYQQKPGKAPKLLIYGASTLQSGVPSRFSGSGSGTEFTLTISSLQPEDFATYYCQQLNSYPLCSFGQGTKLEIK

SEQ ID NO: 1586 - protein, 10 aa, Artificial Sequence
  Description of Artificial Sequence: Synthetic peptide
QQLNSYPLCS

SEQ ID NO: 1587 - protein, 124 aa, Artificial Sequence
  Description of Artificial Sequence: Synthetic polypeptide
QVQLVESGGGVVQPGRSLRLSCAASGFTFSNYGMHWVRQAPGKGLEWVAVISYDGNNKYYADSVKGRFTISRDNSKNTLYLQMNSLRAEDTAVYYCAKDPFPLAVAGTGYFDYWGQGTLVTVSS

SEQ ID NO: 1588 - protein, 17 aa, Artificial Sequence
  Description of Artificial Sequence: Synthetic peptide
AKDPFPLAVAGTGYFDY

SEQ ID NO: 1589 - protein, 108 aa, Artificial Sequence
  Description of Artificial Sequence: Synthetic polypeptide
SYVLTQPPSVSVAPGQTARISCGGNNIGSKNVHWYQQKPGQAPVLVVYDDSDRPSGIPERFSGSNSGNTATLTISRVEAGDEADYYCQVWDSSSDPWVFGGGTKLTVL

SEQ ID NO: 1590 - protein, 11 aa, Artificial Sequence
  Description of Artificial Sequence: Synthetic peptide
QVWDSSSDPWV

SEQ ID NO: 1591 - protein, 117 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDYGDYYFDYWGQGTLVTVSS

SEQ ID NO: 1592 - protein, 11 aa, Artificial Sequence
  Description of Artificial Sequence: Synthetic peptide
ARDYGDYYFDY

SEQ ID NO: 1593 - protein, 107 aa, Artificial Sequence; identical to SEQ ID NO: 1565
  Description of Artificial Sequence: Synthetic polypeptide

SEQ ID NO: 1594 - protein, 9 aa, Artificial Sequence
  Description of Artificial Sequence: Synthetic peptide
QQYNNWPRT

SEQ ID NO: 1595 - protein, 123 aa, Artificial Sequence
  Description of Artificial Sequence: Synthetic polypeptide
QVQLVESGGGVVQPGRSLRLSCAASGFTFNNYGMHWVRQAPGKGLEWVAVISYDGNNKYYADSVKDRFTISRDNSKNTLYLQMNNLRAEDTAMYYCARAGWELLRIRYYFDFWGQGTLVTVSS

SEQ ID NO: 1596 - protein, 16 aa, Artificial Sequence
  Description of Artificial Sequence: Synthetic peptide
ARAGWELLRIRYYFDF

SEQ ID NO: 1597 - protein, 107 aa, Artificial Sequence
  Description of Artificial Sequence: Synthetic polypeptide
DIQMTQSPSSLSASVGDRVTITCQASQDISNYLNWYQQKPGKAPKFLIYGASNLETGVPPRFSGSGSGTDFTFIISSLQPEDIATYYCQQYDNLPPTFGGGTKVEIK

SEQ ID NO: 1598 - protein, 9 aa, Artificial Sequence
  Description of Artificial Sequence: Synthetic peptide
QQYDNLPPT

SEQ ID NO: 1599 - protein, 129 aa, Artificial Sequence
  Description of Artificial Sequence: Synthetic polypeptide
QVQLVQSGAEVKKPGASVKVSCKASGYTFTSYNITWVRQAPGQGLEWVGWISAYNGNTNYAQKFQGRVTMTTDTSTSTAYMELRSLRSDDTAVYYCARVPRGYYDRSGYYYLPHYLDYWGQGTLVTVSS

SEQ ID NO: 1600 - protein, 22 aa, Artificial Sequence
  Description of Artificial Sequence: Synthetic peptide
ARVPRGYYDRSGYYYLPHYLDY

SEQ ID NO: 1601 - protein, 108 aa, Artificial Sequence
  Description of Artificial Sequence: Synthetic polypeptide
DIQMTQSPSSLSASVGDRVTITCQASQDISNYLNWYQQKPGKPPKLLIYDASNLETGVPSRFSGSGSGTDFIFSISSLQPEDIATYYCQQYDSLPGCSFGQGTKLEIK

SEQ ID NO: 1602 - protein, 10 aa, Artificial Sequence
  Description of Artificial Sequence: Synthetic peptide
QQYDSLPGCS

SEQ ID NO: 1603 - protein, 131 aa, Artificial Sequence
  Description of Artificial Sequence: Synthetic polypeptide
QVQLVQSGAEVKKPGASVKVSCKASGYTFTTYYMHWVRQAPGQGLEWMGIINPSGGSTSYAQKFQGRVTMTRDTSTSTVYMELNSLRSEDTAVYYCARGGSSRYCSSTSCYSFGVDNFDYWGQGTLVTVSS

SEQ ID NO: 1604 - protein, 24 aa, Artificial Sequence
  Description of Artificial Sequence: Synthetic peptide
ARGGSSRYCSSTSCYSFGVDNFDY

SEQ ID NO: 1605 - protein, 109 aa, Artificial Sequence
  Description of Artificial Sequence: Synthetic polypeptide
SYVLTQPPSVSVAPGQTARITCGGNNIGSKSVHWYQQKPGQAPVLVVYDDGDRPSGIPERFSGSNSGNTATLTISRVEAGDEADYYCQVWDSSSDHYYVFGTGTKVTVL

SEQ ID NO: 1606 - protein, 12 aa, Artificial Sequence
  Description of Artificial Sequence: Synthetic peptide
QVWDSSSDHYYV

SEQ ID NO: 1607 - protein, 117 aa, Artificial Sequence
  Description of Artificial Sequence: Synthetic polypeptide
EVQLVESGGGLVKPGGSLRLSCAASGFTFSTYSMNWVRQAPGKGLEWVSSISSSSSYIYYADSVKGRFTISRDNAKNSLYLQMNSLRAEDTAVYYCARVVANWFDPWGQGTLVTVSS

SEQ ID NO: 1608 - protein, 10 aa, Artificial Sequence
  Description of Artificial Sequence: Synthetic peptide
ARVVANWFDP

SEQ ID NO: 1609 - protein, 116 aa, Artificial Sequence
  Description of Artificial Sequence: Synthetic polypeptide
  MOD_RES (15)..(15): Any amino acid
DIVMTQSPDSLAVSXGERATINCKSSQSVLYSSNNKNYLAWYQQKPGQPPKLLIYWASTRESGVPDRFSGSGSGTDFTLTISSLQAEDVAVYYCQQYYSTPQPSWTFGQGTKVEIK

SEQ ID NO: 1610 - protein, 12 aa, Artificial Sequence
  Description of Artificial Sequence: Synthetic peptide
QQYYSTPQPSWT

SEQ ID NO: 1611 - protein, 120 aa, Artificial Sequence; identical to SEQ ID NO: 145
  Description of Artificial Sequence: Synthetic polypeptide

SEQ ID NO: 1612 - protein, 13 aa, Artificial Sequence
  Description of Artificial Sequence: Synthetic peptide
ARLSDRWYSPFDP

SEQ ID NO: 1613 - protein, 110 aa, Artificial Sequence
  Description of Artificial Sequence: Synthetic polypeptide
QSVLTQEPSLTVSPGGTVTLTCGSSTGAVTSGHYPYWFQQKSGQAPRTLIYETSIKHSWTPARFSGSLLGGKAALTLSGAQPEDEADYYCLLSYSGARPVFGGGTKLTVL

SEQ ID NO: 1614 - protein, 10 aa, Artificial Sequence
  Description of Artificial Sequence: Synthetic peptide
LLSYSGARPV

SEQ ID NO: 1615 - protein, 120 aa, Artificial Sequence; identical to SEQ ID NO: 145
  Description of Artificial Sequence: Synthetic polypeptide

SEQ ID NO: 1616 - protein, 13 aa, Artificial Sequence
  Description of Artificial Sequence: Synthetic peptide
ARLSDRWYSPFDP

SEQ ID NO: 1617 - protein, 110 aa, Artificial Sequence; identical to SEQ ID NO: 1613
  Description of Artificial Sequence: Synthetic polypeptide

SEQ ID NO: 1618 - protein, 10 aa, Artificial Sequence
  Description of Artificial Sequence: Synthetic peptide
LLSYSGARPV

SEQ ID NO: 1619 - protein, 119 aa, Artificial Sequence
  Description of Artificial Sequence: Synthetic polypeptide
EVQLVETGGGLIQPGGSLRLSCAASGFTVSSNYMSWVRQAPGKGLEWVSVIYSGGSTFYADSVKGRFTISRDNSKNTLYLQMNSLRAEDTAVYYCARAISESPRYGVYWGQGTLVTVSS

SEQ ID NO: 1620 - protein, 13 aa, Artificial Sequence
  Description of Artificial Sequence: Synthetic peptide
ARAISESPRYGVY

SEQ ID NO: 1621 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGQGTRLEIK

SEQ ID NO: 1622 - protein, 9 aa, Artificial Sequence
  Description of Artificial Sequence: Synthetic peptide
QQYDNLPLT

SEQ ID NO: 1623 - protein, 129 aa, Artificial Sequence
  Description of Artificial Sequence: Synthetic polypeptide
EVQLVESGGGLVQPGGSLRLSCAASGFSVSTKYMTWVRQAPGKGLEWVSVLYSGGSDYYADSVKGRFTISRDNSKNALYLQMSSLRVEDTGIYYCARDSSEVRDHPGHPGRSVGAFDIWGQGTMVTVSS

SEQ ID NO: 1624 - protein, 23 aa, Artificial Sequence
  Description of Artificial Sequence: Synthetic peptide
ARDSSEVRDHPGHPGRSVGAFDI

SEQ ID NO: 1625 - protein, 110 aa, Artificial Sequence; identical to SEQ ID NO: 1537
  Description of Artificial Sequence: Synthetic polypeptide

SEQ ID NO: 1626 - protein, 10 aa, Artificial Sequence
  Description of Artificial Sequence: Synthetic peptide
CSYAGASTFV

SEQ ID NO: 1627 - protein, 118 aa, Artificial Sequence
  Description of Artificial Sequence: Synthetic polypeptide
EVQLVESGGGLVKPGGSLRLSCAASGFTFSSYIMNWVRQAPGKGLEWVSSISSSSSYIYYADSVKGRFTISRDNAKNSLYLQMNSLRAEDTAVYYCAREAEWEAFDIWGQGTMVTVSS

SEQ ID NO: 1628 - protein, 11 aa, Artificial Sequence
  Description of Artificial Sequence: Synthetic peptide
AREAEWEAFDI

SEQ ID NO: 1629 - protein, 110 aa, Artificial Sequence
  Description of Artificial Sequence: Synthetic polypeptide
QSVLTQPRSVSGSPGQSVTISCTGTSSDVGGYNYVSWYQQHPGKAPKLMICDVSKRPSGVPDRFSGSKSGNTASLTISGLQAEDEADYYCCSYAGSYTWVFGGGTKLTVL

SEQ ID NO: 1630 - protein, 10 aa, Artificial Sequence
  Description of Artificial Sequence: Synthetic peptide
CSYAGSYTWV

SEQ ID NO: 1631 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKVDGSYYYYYYGMDVWGQGTTVTVSS

SEQ ID NO: 1632 - protein, 16 aa, Artificial Sequence
  Description of Artificial Sequence: Synthetic peptide
AKVDGSYYYYYYGMDV

SEQ ID NO: 1633 - protein, 111 aa, Artificial Sequence
  Description of Artificial Sequence: Synthetic polypeptide
QSVLTQPASVSGSPGQSITISCTGTSSDVGAYNYVSWYQQHPGKAPKLMIYEVSNRPSGVSNRFSGSKSGNTASLTISGLQAEDEADYYCSSYTSSSTAWVFGGGTKLTVL

SEQ ID NO: 1634 - protein, 11 aa, Artificial Sequence
  Description of Artificial Sequence: Synthetic peptide
SSYTSSSTAWV

SEQ ID NO: 1635 - protein, 130 aa, Artificial Sequence; identical to SEQ ID NO: 1423
  Description of Artificial Sequence: Synthetic polypeptide

SEQ ID NO: 1636 - protein, 23 aa, Artificial Sequence
  Description of Artificial Sequence: Synthetic peptide
AREQEANYYDISGYYHWGESLGY

SEQ ID NO: 1637 - protein, 108 aa, Artificial Sequence
  Description of Artificial Sequence: Synthetic polypeptide
DIQLTQSPSFLSASVGDRVTITCRASQGISSYLAWYQQKPGKAPKLLIYGASTLQSGVPSRFSGSGSGTEFTLTISSLQPEDFASYYCQKVNSHPPGLTFGGGTKVEI

SEQ ID NO: 1638 - protein, 11 aa, Artificial Sequence
  Description of Artificial Sequence: Synthetic peptide
QKVNSHPPGLT

SEQ ID NO: 1639 - protein, 127 aa, Artificial Sequence
  Description of Artificial Sequence: Synthetic polypeptide
QVQLQQSGPGLVKPSQTLSLTCAISGDSVSSNTAAWNWIRQSPSRGLEWLGRTYYRSKWYNDYAVSVISRIIINPDTSKNQFSLQLKSVTPEDTAVYYCARDILRDTSWPHDAFDIWGQGTMVTVSS

SEQ ID NO: 1640 - protein, 17 aa, Artificial Sequence
  Description of Artificial Sequence: Synthetic peptide
ARDILRDTSWPHDAFDI

SEQ ID NO: 1641 - protein, 112 aa, Artificial Sequence
  Description of Artificial Sequence: Synthetic polypeptide
QSVLTQPASVSGSPGQSITISCTGTSSDVGGYNYLSWYQQHPGKAPKLMIYEVSNRPSGVSNRFSGSKSGNTASLTISGLQAEDEADYYCSSYTSSSTPFYVFGTGTKVTVL

SEQ ID NO: 1642 - protein, 12 aa, Artificial Sequence
  Description of Artificial Sequence: Synthetic peptide
SSYTSSSTPFYV

SEQ ID NO: 1643 - protein, 130 aa, Artificial Sequence; identical to SEQ ID NO: 15
  Description of Artificial Sequence: Synthetic polypeptide

SEQ ID NO: 1644 - protein, 23 aa, Artificial Sequence
  Description of Artificial Sequence: Synthetic peptide
ARGPLFHRLVYDFWSGYHDGFDM

SEQ ID NO: 1645 - protein, 110 aa, Artificial Sequence
  Description of Artificial Sequence: Synthetic polypeptide
QSVLTQPASVSGSPGQSITISCTGTSSDVGGYKFVSWYQQHPGKAPKLMIYEVSNRPSGVSNRFSGSKSGNTASLTISGLQAEDEADYYCNSYTSSSTWVFGGGTKLTVL

SEQ ID NO: 1646 - protein, 10 aa, Artificial Sequence
  Description of Artificial Sequence: Synthetic peptide
NSYTSSSTWV

SEQ ID NO: 1647 - protein, 121 aa, Artificial Sequence
  Description of Artificial Sequence: Synthetic polypeptide
QVQLVESGGGVVQPGRSLRLSCAASGLTFSFYAIHWVRQAPGKGLEWVAYISYEGSDKYYADSVKGRFTISRANSKSTLYLQMNSLRAEDTAVYYCYALFERGNWNDAEYWGQGTLVTVSS

SEQ ID NO: 1648 - protein, 14 aa, Artificial Sequence
  Description of Artificial Sequence: Synthetic peptide
YALFERGNWNDAEY

SEQ ID NO: 1649 - protein, 112 aa, Artificial Sequence
  Description of Artificial Sequence: Synthetic polypeptide
DVVMTQSPLSLPVTLGQPASISCRSSQSLVHSDGNIYLSWYQQRPGQSPRRLIYKVSNRDSGVPDRFSASGSGTDFTLRISRVEAEDVGVYYCMQGTHWPRTFGQGTKLEIK

SEQ ID NO: 1650 - protein, 9 aa, Artificial Sequence
  Description of Artificial Sequence: Synthetic peptide
MQGTHWPRT

SEQ ID NO: 1651 - protein, 122 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARERGYYGGKTPPFLGGQGTLVTVSS

SEQ ID NO: 1652 - protein, 15 aa, Artificial Sequence
  Description of Artificial Sequence: Synthetic peptide
ARERGYYGGKTPPFL

SEQ ID NO: 1653 - protein, 111 aa, Artificial Sequence; identical to SEQ ID NO: 22
  Description of Artificial Sequence: Synthetic polypeptide

SEQ ID NO: 1654 - protein, 10 aa, Artificial Sequence
  Description of Artificial Sequence: Synthetic peptide
QSYDSSNYWV

SEQ ID NO: 1655 - protein, 132 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSGGRHYYDSSGYYRLPLDDAFDIWGQGTMVTVSS

SEQ ID NO: 1656 - protein, 25 aa, Artificial Sequence
  Description of Artificial Sequence: Synthetic peptide
AKSGGRHYYDSSGYYRLPLDDAFDI

SEQ ID NO: 1657 - protein, 112 aa, Artificial Sequence
  Description of Artificial Sequence: Synthetic polypeptide
QSVLTQPPSVSGAPGQRVTISCTGSSSSIGAGYDVHWYQQLPGTAPKLLIYGNSNRPSGVPDRFSGSKSGTSASLAITGLQAEDEADYYCQSYDSSLSGSWVFGGGTKLTVL

SEQ ID NO: 1658 - protein, 12 aa, Artificial Sequence
  Description of Artificial Sequence: Synthetic peptide
QSYDSSLSGSWV

SEQ ID NO: 1659 - protein, 134 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARYQLAPGSGSYYNWGGYPRESEYYFDYWGQGTLVTVSS

SEQ ID NO: 1660 - protein, 28 aa, Artificial Sequence
  Description of Artificial Sequence: Synthetic peptide
ARYQLAPGSGSYYNWGGYPRESEYYFDY

SEQ ID NO: 1661 - protein, 110 aa, Artificial Sequence
  Description of Artificial Sequence: Synthetic polypeptide
QSVLTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTWVFGGGTKLTVL

SEQ ID NO: 1662 - protein, 10 aa, Artificial Sequence
  Description of Artificial Sequence: Synthetic peptide
CSYAGSYTWV

SEQ ID NO: 1663 - protein, 121 aa, Artificial Sequence
  Description of Artificial Sequence: Synthetic polypeptide
QVQLQESGPGLVKPSQTLSLTCAVSGDSIRSGGYYWSWVRQHPGRGLEWIGYIYFSGTTYYNPSLKSRVTISVDTSEKQFSLKLTSVTDADTAVYFCARVKGWLRGYFDYWGQGAPVTVSA

SEQ ID NO: 1664 - protein, 13 aa, Artificial Sequence
  Description of Artificial Sequence: Synthetic peptide
ARVKGWLRGYFDY

SEQ ID NO: 1665 - protein, 110 aa, Artificial Sequence
  Description of Artificial Sequence: Synthetic polypeptide
NFMLTQSHSVSESPGKTVTISCTGSSGNIVNNYVQWYQQRPGSAPIIVIYEDTQRPSGVPDRFSGSIDTSSNSASLTISGLKTEDEADYYCQSYDSGSHVVFGGGTKLTV

SEQ ID NO: 1666 - protein, 10 aa, Artificial Sequence
  Description of Artificial Sequence: Synthetic peptide
QSYDSGSHVV

SEQ ID NO: 1667 - protein, 129 aa, Artificial Sequence [sequence omitted]

SEQ ID NO: 1668 - protein, 23 aa, Artificial Sequence
  Description of Artificial Sequence: Synthetic peptide
ARDSSEVRDHPGHPGRSVGAFDI

SEQ ID NO: 1669 - protein, 110 aa, Artificial Sequence
  Description of Artificial Sequence: Synthetic polypeptide
QSVLTQPASVSGSPGQSITISCTGTSNDVGSYTLVSWYQQYPGKAPKLLIFEVTKRSSGISNRFSGSKSGNTASLTISGLQGEDEADYYCCSYAGASTFVFGGGTKLTVL

SEQ ID NO: 1670 - protein, 10 aa, Artificial Sequence
  Description of Artificial Sequence: Synthetic peptide
CSYAGASTFV

SEQ ID NO: 1671 - protein, 118 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARVGYGYYFDYWGQGTLVTVSS

SEQ ID NO: 1672 - protein, 11 aa, Artificial Sequence
  Description of Artificial Sequence: Synthetic peptide
ARVGYGYYFDY

SEQ ID NO: 1673 - protein, 106 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPSFGQGTKLEIK

SEQ ID NO: 1674 - protein, 8 aa, Artificial Sequence
  Description of Artificial Sequence: Synthetic peptide
QQRSNWPS

SEQ ID NO: 1675 - protein, 125 aa, Artificial Sequence
  Description of Artificial Sequence: Synthetic polypeptide
QVQLVQSGAEVKKPGASVKVSCKASGYTFTSYYIHWVRQAPGQGLEWMGIINPSDGGTSYAQKFQGRVTMTRDTSTSTVYMELSSLRSEDTAVYSCARASTSTTNWNDALSLGCWGQGTLVTVSS

SEQ ID NO: 1676 - protein, 18 aa, Artificial Sequence
  Description of Artificial Sequence: Synthetic peptide
ARASTSTTNWNDALSLGC

SEQ ID NO: 1677 - protein, 113 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSGLSGSGVVFGGGTKLTVL

SEQ ID NO: 1678 - protein, 13 aa, Artificial Sequence
  Description of Artificial Sequence: Synthetic peptide
QSYDSGLSGSGVV

SEQ ID NO: 1679 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRKYSSGWSVVNFDYWGQGTLVTVSS

SEQ ID NO: 1680 - protein, 17 aa, Artificial Sequence
  Description of Artificial Sequence: Synthetic peptide
ARDRKYSSGWSVVNFDY

SEQ ID NO: 1681 - protein, 110 aa, Artificial Sequence
  Description of Artificial Sequence: Synthetic polypeptide
QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNGWVFGGGTKLTVL

SEQ ID NO: 1682 - protein, 11 aa, Artificial Sequence
  Description of Artificial Sequence: Synthetic peptide
AAWDDSLNGWV

SEQ ID NO: 1683 - protein, 118 aa, Artificial Sequence
  Description of Artificial Sequence: Synthetic polypeptide
EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCARDSTPGYGDYISGQGTLVTVSS

SEQ ID NO: 1684 - skipped

SEQ ID NO: 1685 - protein, 107 aa, Artificial Sequence; identical to SEQ ID NO: 1009
  Description of Artificial Sequence: Synthetic polypeptide

SEQ ID NO: 1686 - protein, 9 aa, Artificial Sequence
  Description of Artificial Sequence: Synthetic peptide
QQYDNLPIT

SEQ ID NO: 1687 - protein, 119 aa, Artificial Sequence
  Description of Artificial Sequence: Synthetic polypeptide
QVQLVESGGGVVQPGRSLRLSCADSGFTFSTYGMHWVRQAPGKGLEWVALISYDGSNKYYADSVKGRFTISGDNSKNTLYLQMNSLRAEDTAVYYCARAEWLRGAFDIWGQGTMVTVSS

SEQ ID NO: 1688 - protein, 12 aa, Artificial Sequence
  Description of Artificial Sequence: Synthetic peptide
ARAEWLRGAFDI

SEQ ID NO: 1689 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSTNHWVFGGGTKLTVL

SEQ ID NO: 1690 - protein, 10 aa, Artificial Sequence
  Description of Artificial Sequence: Synthetic peptide
QSYDSTNHWV

SEQ ID NO: 1691 - protein, 131 aa, Artificial Sequence
  Description of Artificial Sequence: Synthetic polypeptide
EVQLVESGGGLIQPGGSLRLSCAASGFSVSSNYMSWVRQAPGKGLEWVSVIYSGGSTYYADSVKGRFTISRDNSKNTLYLQMNSLRAEDTAVYYCAREGEVEGYYDFWSGYSRDRYYFDYWGQGTLVTVSS

SEQ ID NO: 1692 - protein, 25 aa, Artificial Sequence
  Description of Artificial Sequence: Synthetic peptide
AREGEVEGYYDFWSGYSRDRYYFDY

SEQ ID NO: 1693 - protein, 110 aa, Artificial Sequence
  Description of Artificial Sequence: Synthetic polypeptide
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSTTRVFGTGTRVTVL

SEQ ID NO: 1694 - protein, 10 aa, Artificial Sequence
  Description of Artificial Sequence: Synthetic peptide
SSYTSSTTRV

SEQ ID NO: 1695 - protein, 131 aa, Artificial Sequence
  Description of Artificial Sequence: Synthetic polypeptide
EVQLVESGGGLIQPGGSLRLSCAASGFTVSNNYMSWVRQAPGKGLEWVSVIYSGGSTYYADSLKGRFTISRDNSKNTLYLQMNSLRAEDTAVYYCAREGEVEGYYDFWSGYSRDRYYFDYWGQGTLVTVSS

SEQ ID NO: 1696 - protein, 25 aa, Artificial Sequence
  Description of Artificial Sequence: Synthetic peptide
AREGEVEGYYDFWSGYSRDRYYFDY

SEQ ID NO: 1697 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSISTRVFGTGTKVTVL

SEQ ID NO: 1698 - protein, 10 aa, Artificial Sequence
  Description of Artificial Sequence: Synthetic peptide
SSYTSISTRV

SEQ ID NO: 1699 - protein, 122 aa, Artificial Sequence
  Description of Artificial Sequence: Synthetic polypeptide
QVQLVQSGAEVKKPGASVKVSCKASGYTFTGYYIHWVRQAPGQGLEWMGWINPNSGGTKYAQKFQGWVTMTRDTSITTVYMELSRLRSDDTAVYYCARGTEYNWNSAHFDPWGQGTLVTVSS

SEQ ID NO: 1700 - protein, 15 aa, Artificial Sequence
  Description of Artificial Sequence: Synthetic peptide
ARGTEYNWNSAHFDP

SEQ ID NO: 1701 - protein, 111 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTSWVFGGGTKLTVL

SEQ ID NO: 1702 - protein, 11 aa, Artificial Sequence
  Description of Artificial Sequence: Synthetic peptide
SSYTSSSTSWV

SEQ ID NO: 1703 - protein, 129 aa, Artificial Sequence; identical to SEQ ID NO: 1623
  Description of Artificial Sequence: Synthetic polypeptide

SEQ ID NO: 1704 - protein, 23 aa, Artificial Sequence
  Description of Artificial Sequence: Synthetic peptide
ARDSSEVRDHPGHPGRSVGAFDI

SEQ ID NO: 1705 - protein, 110 aa, Artificial Sequence; identical to SEQ ID NO: 316
  Description of Artificial Sequence: Synthetic polypeptide

SEQ ID NO: 1706 - protein, 10 aa, Artificial Sequence
  Description of Artificial Sequence: Synthetic peptide
CSYAGASTFV

SEQ ID NO: 1707 - protein, 115 aa, Artificial Sequence; identical to SEQ ID NO: 39
  Description of Artificial Sequence: Synthetic polypeptide

SEQ ID NO: 1708 - protein, 8 aa, Artificial Sequence
  Description of Artificial Sequence: Synthetic peptide
ARERYGDN

SEQ ID NO: 1709 - protein, 109 aa, Artificial Sequence; identical to SEQ ID NO: 40
  Description of Artificial Sequence: Synthetic polypeptide

SEQ ID NO: 1710 - protein, 7 aa, Artificial Sequence
  Description of Artificial Sequence: Synthetic peptide
QTWGPWV

SEQ ID NO: 1711 - protein, 125 aa, Artificial Sequence
  Description of Artificial Sequence: Synthetic polypeptide
QVQLVESGGGVVQPGRSLRLSCTASGFTFSSYGMHWVRQAPGKGLEWVAVISYDGSNKYYADSVKGRFTISRDNSKNTLYLQMNSLRAEDTAVYYCAKVGLGYSSGWYGEEIDYWGQGTLVTVSS

SEQ ID NO: 1712 - protein, 18 aa, Artificial Sequence
  Description of Artificial Sequence: Synthetic peptide
AKVGLGYSSGWYGEEIDY

SEQ ID NO: 1713 - protein, 107 aa, Artificial Sequence
  Description of Artificial Sequence: Synthetic polypeptide
DIQMTQSPSSLSASVGDRVTITCRASQSISSFLNWYQQKPGKAPNLLIYAASSLQSGVPSRFSGSGSGTDFTLTISSLQPEDFATYYCQQSYRTPLTFGGGTKVEIK

SEQ ID NO: 1714 - protein, 9 aa, Artificial Sequence
  Description of Artificial Sequence: Synthetic peptide
QQSYRTPLT

SEQ ID NO: 1715 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGGRYYDSSGYNGTYEFDYWGQGTLVTVSS

SEQ ID NO: 1716 - protein, 20 aa, Artificial Sequence
  Description of Artificial Sequence: Synthetic peptide
ARGGRYYDSSGYNGTYEFDY

SEQ ID NO: 1717 - protein, 108 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPPVTFGPGTKVDIK

SEQ ID NO: 1718 - protein, 10 aa, Artificial Sequence
  Description of Artificial Sequence: Synthetic peptide
QQYNNWPPVT

SEQ ID NO: 1719 - protein, 128 aa, Artificial Sequence
  Description of Artificial Sequence: Synthetic polypeptide
QVQLQESGPGLVKPSETLSLTCTVSGGSISNYYWSWIRQPPGKGLEWIGYIYTSGSTNYNPSLKSRVTISVDTSKNQFSLKLSSVTAADTAVYYCARGPPRLLWFGESPPTYWYFNLWGRGTLVTVSS

SEQ ID NO: 1720 - protein, 22 aa, Artificial Sequence
  Description of Artificial Sequence: Synthetic peptide
ARGPPRLLWFGESPPTYWYFNL

SEQ ID NO: 1721 - protein, 113 aa, Artificial Sequence
  Description of Artificial Sequence: Synthetic polypeptide
  MOD_RES (15)..(15): Any amino acid
DIVMTQSPDSLAVSXGERATINCKSSQSVLYSSNNKNYLAWYQQKPRQPPKLLIYWASTRESGVPDRISGSGSGTDFTLTISSLQAEDVAVYYCQQYYSTPLTFGGGTKVEIK

SEQ ID NO: 1722 - protein, 9 aa, Artificial Sequence
  Description of Artificial Sequence: Synthetic peptide
QQYYSTPLT

SEQ ID NO: 1723 - protein, 116 aa, Artificial Sequence
  Description of Artificial Sequence: Synthetic polypeptide
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARVAAFLDYWGQGTLVTVSS

SEQ ID NO: 1724 - protein, 9 aa, Artificial Sequence
  Description of Artificial Sequence: Synthetic peptide
ARVAAFLDY

SEQ ID NO: 1725 - protein, 106 aa, Artificial Sequence
  Description of Artificial Sequence: Synthetic polypeptide
DIQMTQSPSSLSASVGDRVTITCRASQGISNSLAWYQQKPGKAPKLLLYAASRLESGVPSRFSGSGSGTDYTLTISSLQPEDFATYYCQQYYSTRTFGQGTKVEIK

SEQ ID NO: 1726 - protein, 8 aa, Artificial Sequence
  Description of Artificial Sequence: Synthetic peptide
QQYYSTRT

SEQ ID NO: 1727 - protein, 127 aa, Artificial Sequence
  Description of Artificial Sequence: Synthetic polypeptide
QLQLQESGSRLVKPSQTLSLTCAVSGGSISSGGYSWSWIRQPPGKGLQWIGYIYHSGSTYYNPSLKSRVTISVDRSKNQFSLKLSSVTAADTAVYYCARFTNPNYYDSSGYYGFDYWGQGTLVTVSS

SEQ ID NO: 1728 - protein, 19 aa, Artificial Sequence
  Description of Artificial Sequence: Synthetic peptide
ARFTNPNYYDSSGYYGFDY

SEQ ID NO: 1729 - protein, 110 aa, Artificial Sequence
  Description of Artificial Sequence: Synthetic polypeptide
QSVLTQPPSASGSPGQSVTISCTGTSSDVGGYNYVSWYQQHPGKAPKLMIYEVSKRPSGVPDRLSGSKSGNTASLTVSGLQAEDEADYYCTSYAGSNNWVFGGGTKLTVL

SEQ ID NO: 1730 - protein, 10 aa, Artificial Sequence
  Description of Artificial Sequence: Synthetic peptide
TSYAGSNNWV

SEQ ID NO: 1731 - protein, 125 aa, Artificial Sequence
  Description of Artificial Sequence: Synthetic polypeptide
QVQLVQSGAEVKKPGSSVKVSCKASGGTFSSDAISWVRQAPGQGLEWMGGIMPIFGTANYAQKFQGRVTITADESTSTAYMELSSLRSEDTAVYYCARDLRYCSGGRCLWWFDPWGQGTLVTVSS

SEQ ID NO: 1732 - protein, 18 aa, Artificial Sequence
  Description of Artificial Sequence: Synthetic peptide
ARDLRYCSGGRCLWWFDP

SEQ ID NO: 1733 - protein, 107 aa, Artificial Sequence
  Description of Artificial Sequence: Synthetic polypeptide
DIQMTQSPSSLSASVGDRVTITCRASQSINNYLNWYQQKPGKAPKLLIYAASSLQSGVPSRFSGSGSGTDFTLTISSLQPEDFATYYCQQSYSTPRTFGPGTKVDIK

SEQ ID NO: 1734 - protein, 9 aa, Artificial Sequence
  Description of Artificial Sequence: Synthetic peptide
QQSYSTPRT

SEQ ID NO: 1735 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVTSYDGTNKYYADSVKGRFTISRDNSKNTLYLQMNSLRAEDTAVYFCAKNVGTGYNVMYYFDYWGQGTLVTVSS

SEQ ID NO: 1736 - protein, 16 aa, Artificial Sequence
  Description of Artificial Sequence: Synthetic peptide
AKNVGTGYNVMYYFDY

SEQ ID NO: 1737 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDTSNLERGVPSRFSGSGSGSDFTFTISSLQPEDIATYYCQQYDNLPITFGQGTRLEIK

SEQ ID NO: 1738 - protein, 9 aa, Artificial Sequence
  Description of Artificial Sequence: Synthetic peptide
QQYDNLPIT

SEQ ID NO: 1739 - protein, 131 aa, Artificial Sequence
  Description of Artificial Sequence: Synthetic polypeptide
QVQLVQSGAEVKKPGASVKVSCKASGYTFTGYYLHWVRQAPGQGLEWMGWINPNSGGTNYAQKFQGWVTMTRDTSISTAYMELSRLRSDDTAVYYCARTPRVYDPTLPNQWLVGEYYCDYWGQGTLVTVSS

SEQ ID NO: 1740 - protein, 24 aa, Artificial Sequence
  Description of Artificial Sequence: Synthetic peptide
ARTPRVYDPTLPNQWLVGEYYCDY

SEQ ID NO: 1741 - protein, 110 aa, Artificial Sequence
  Description of Artificial Sequence: Synthetic polypeptide
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTWVFGGGTKLTVL

SEQ ID NO: 1742 - protein, 10 aa, Artificial Sequence
  Description of Artificial Sequence: Synthetic peptide
CSYAGSYTWV

SEQ ID NO: 1743 - protein, 128 aa, Artificial Sequence
  Description of Artificial Sequence: Synthetic polypeptide
QVQLVQSGAEVKKPGSSVKVSCKASGGTFSSNYAISWVRQAPGQGLEWMGGIIPIFGTANYAQKLQGRVTITTDESTSTAYMELSSLRSEDTAVYYCARYTYYYDRSGYYRPDYFDYWGQGTLVTVSS

SEQ ID NO: 1744 - protein, 20 aa, Artificial Sequence
  Description of Artificial Sequence: Synthetic peptide
ARYTYYYDRSGYYRPDYFDY

SEQ ID NO: 1745 - protein, 107 aa, Artificial Sequence
  Description of Artificial Sequence: Synthetic polypeptide
AIQLTQSPSSLSASVGDRVTITCRASQGISTVLAWYQQKPGKTPKLLIYDASSLESGAPSRFSGSGSGTDFTLTISSLQPEDFATYYCQQFNSYQLTFGGGTKVEIK

SEQ ID NO: 1746 - protein, 9 aa, Artificial Sequence
  Description of Artificial Sequence: Synthetic peptide
QQFNSYQLT

SEQ ID NO: 1747 - protein, 119 aa, Artificial Sequence
  Description of Artificial Sequence: Synthetic polypeptide
EVQLVESGGGLVQPGGSLRLSCAASGFTFSSYWMHWVRQAPGKGLVWVSHINGDGSSTSYADSVKGRFTISRDNAKNTLYLQMNSLRAEDTAVYYCASAFWQRGNFDYWGQGTLVTVSS

SEQ ID NO: 1748 - protein, 12 aa, Artificial Sequence
  Description of Artificial Sequence: Synthetic peptide
ASAFWQRGNFDY

SEQ ID NO: 1749 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSILWVFGGGTKLTVL

SEQ ID NO: 1750 - protein, 10 aa, Artificial Sequence
  Description of Artificial Sequence: Synthetic peptide
QSYDSSILWV

SEQ ID NO: 1751 - protein, 120 aa, Artificial Sequence
  Description of Artificial Sequence: Synthetic polypeptide
QVQLVQSGAEVKKPGASVKVSCKASGYTFTSYDISWVRQAPGQGLEWMGWINAYNGNTNYAQKLQGRVTMTTDTSTSTAYMELRSLRSDDTAVYYCARPSSSLTSYFDYWGQGTLVTVSS

SEQ ID NO: 1752 - protein, 13 aa, Artificial Sequence
  Description of Artificial Sequence: Synthetic peptide
ARPSSSLTSYFDY

SEQ ID NO: 1753 - protein, 109 aa, Artificial Sequence
  Description of Artificial Sequence: Synthetic polypeptide
SYVLTQPPSVSVAPGQTARITCGGNNIGSKNVHWYQQKPGQAPVLVVYDDSDRPSGIPERFSGSNSGNTATLTISRVEAGDEADYYCQVWDSSSDRHWVFGGGTKLTVL

SEQ ID NO: 1754 - protein, 12 aa, Artificial Sequence
  Description of Artificial Sequence: Synthetic peptide
QVWDSSSDRHWV

SEQ ID NO: 1755 - protein, 122 aa, Artificial Sequence
  Description of Artificial Sequence: Synthetic polypeptide
EVQLVESGGGLVKPGGSLRLSCAASGFTFSSYNMNWVRQAPGKGLEWVSCISSSSSYIYYADSVKGRFTISRDNAKNSLYLQMNSLRAEDTAVYYCARERGYDGGKTPPFLGGQGTLVTVSS

SEQ ID NO: 1756 - protein, 15 aa, Artificial Sequence
  Description of Artificial Sequence: Synthetic peptide
ARERGYDGGKTPPFL

SEQ ID NO: 1757 - protein, 111 aa, Artificial Sequence; identical to SEQ ID NO: 22
  Description of Artificial Sequence: Synthetic polypeptide

SEQ ID NO: 1758 - protein, 10 aa, Artificial Sequence
  Description of Artificial Sequence: Synthetic peptide
QSYDSSNYWV

SEQ ID NO: 1759 - protein, 131 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCAREGDVEGYYDFWSGYSRDRYYFDYWGQGTLVTVSS

SEQ ID NO: 1760 - protein, 25 aa, Artificial Sequence
  Description of Artificial Sequence: Synthetic peptide
AREGDVEGYYDFWSGYSRDRYYFDY

SEQ ID NO: 1761 - protein, 110 aa, Artificial Sequence; identical to SEQ ID NO: 318
  Description of Artificial Sequence: Synthetic polypeptide

SEQ ID NO: 1762 - protein, 10 aa, Artificial Sequence
  Description of Artificial Sequence: Synthetic peptide
SSYTSSSTRV

SEQ ID NO: 1763 - protein, 117 aa, Artificial Sequence
  Description of Artificial Sequence: Synthetic polypeptide
EVQLVESGGGLIQPGGSLRLSCAASGFIVSSNYMSWVRQAPGKGLEWVSVIYSGGSTFYADSVKGRFTISRDNSKNTLYLQMNSLRAEDTAVYYCARDFGEFYFDYWGQGTLVTVSS

SEQ ID NO: 1764 - protein, 11 aa, Artificial Sequence
  Description of Artificial Sequence: Synthetic peptide
ARDFGEFYFDY

SEQ ID NO: 1765 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATAIPARFSGSGSGTEFTLTISSLQSEDFAVYYCQQYNNWPRTFGQGTKVEIK

SEQ ID NO: 1766 - protein, 9 aa, Artificial Sequence
  Description of Artificial Sequence: Synthetic peptide
QQYNNWPRT

SEQ ID NO: 1767 - protein, 120 aa, Artificial Sequence
  Description of Artificial Sequence: Synthetic polypeptide
QVQLVQSGAEVKKPGASVKVSCMASGYTLTAYYIHWVRQAPGQGLESLGWINPRTGGTTILQKFQGWVTMTRDTSINTVYLELPRVTLADTAVYYCVRGGTWNYVGGEVWGQGTAVTVSS

SEQ ID NO: 1768 - protein, 13 aa, Artificial Sequence
  Description of Artificial Sequence: Synthetic peptide
VRGGTWNYVGGEV

SEQ ID NO: 1769 - protein, 111 aa, Artificial Sequence
  Description of Artificial Sequence: Synthetic polypeptide
QSALTQPASVSGSPGQSITVSCAGSSTDVGGYNFVSWYQHHPGRVPKLIIYEVNNRPSGVSVRFSGSKSGNTASLTISGLQAEDEADYYCTSFTSSSDSWIFGGGTKLTVL

SEQ ID NO: 1770 - protein, 11 aa, Artificial Sequence
  Description of Artificial Sequence: Synthetic peptide
TSFTSSSDSWI

SEQ ID NO: 1771 - protein, 122 aa, Artificial Sequence
  Description of Artificial Sequence: Synthetic polypeptide
QVQLVESGGGVVQPGRSLRLSCAASGFTFSGYDIHWVRQAPGKGLEWVAVISYDGSSKFYADSVKGRFTISRDNSKNTLYLQMNSLRAEDTAVYYCAKDLGSSLYYDAFDIWGQGTMVTVSS

SEQ ID NO: 1772 - protein, 15 aa, Artificial Sequence
  Description of Artificial Sequence: Synthetic peptide
AKDLGSSLYYDAFDI

SEQ ID NO: 1773 - protein, 108 aa, Artificial Sequence
  Description of Artificial Sequence: Synthetic polypeptide
DIQMTQSPSSLSASVGDRLTITCRASQSITSYLNWYQQKPGKAPKLLIYAASSLQSGVPSRFSGSGSGTDFTLTISSLQPEDFATYYCQQSYSTPPWTFGQGTKVEIK

SEQ ID NO: 1774 - protein, 10 aa, Artificial Sequence
  Description of Artificial Sequence: Synthetic peptide
QQSYSTPPWT

SEQ ID NO: 1775 - protein, 131 aa, Artificial Sequence
  Description of Artificial Sequence: Synthetic polypeptide
EVQLVESGGGLIQPGGSLRLSCAASGFTVRNNYMSWVRQAPGKGLEWVSVIYSGGSTYYADSVKGRFTISRDNSKNTLYLQMNSLRAEDTAVYYCAREGEVEGYYDFWSGYSRDRYYFDYWGQGTLVTVSS

SEQ ID NO: 1776 - protein, 25 aa, Artificial Sequence
  Description of Artificial Sequence: Synthetic peptide
AREGEVEGYYDFWSGYSRDRYYFDY

SEQ ID NO: 1777 - protein, 110 aa, Artificial Sequence; identical to SEQ ID NO: 318
  Description of Artificial Sequence: Synthetic polypeptide

SEQ ID NO: 1778 - protein, 10 aa, Artificial Sequence
  Description of Artificial Sequence: Synthetic peptide
SSYTSSSTRV

SEQ ID NO: 1779 - protein, 131 aa, Artificial Sequence; identical to SEQ ID NO: 1691
  Description of Artificial Sequence: Synthetic polypeptide

SEQ ID NO: 1780 - protein, 25 aa, Artificial Sequence
  Description of Artificial Sequence: Synthetic peptide
AREGEVEGYYDFWSGYSRDRYYFDY

SEQ ID NO: 1781 - protein, 110 aa, Artificial Sequence; identical to SEQ ID NO: 1693
  Description of Artificial Sequence: Synthetic polypeptide

SEQ ID NO: 1782 - protein, 10 aa, Artificial Sequence
  Description of Artificial Sequence: Synthetic peptide
SSYTSSTTRV

SEQ ID NO: 1783 - protein, 129 aa, Artificial Sequence [sequence omitted]

SEQ ID NO: 1784 - protein, 23 aa, Artificial Sequence
  Description of Artificial Sequence: Synthetic peptide
ARDSSEVRDHPGHPGRSVGAFDI

SEQ ID NO: 1785 - protein, 110 aa, Artificial Sequence; identical to SEQ ID NO: 1537
  Description of Artificial Sequence: Synthetic polypeptide

SEQ ID NO: 1786 - protein, 10 aa, Artificial Sequence
  Description of Artificial Sequence: Synthetic peptide
CSYAGASTFV

SEQ ID NO: 1787 - protein, 122 aa, Artificial Sequence
  Description of Artificial Sequence: Synthetic polypeptide
EVQLVESGGGLIQPGGSLRLSCAASGFTVSSNYMSWVRQAPGKGLEWVSVIYSGYSTYYVDSVKGRFTISRDNSKNTLYLQMNSLRAEDTAVYYCARVGGAHSGYDGSFDYWGQGTLVTVSS

SEQ ID NO: 1788 - protein, 16 aa, Artificial Sequence
  Description of Artificial Sequence: Synthetic peptide
ARVGGAHSGYDGSFDY

SEQ ID NO: 1789 - protein, 110 aa, Artificial Sequence
  Description of Artificial Sequence: Synthetic polypeptide
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVL

SEQ ID NO: 1790 - protein, 10 aa, Artificial Sequence
  Description of Artificial Sequence: Synthetic peptide
CSYAGSSTWV

SEQ ID NO: 1791 - protein, 123 aa, Artificial Sequence
  Description of Artificial Sequence: Synthetic polypeptide
QVQLVESGGGVVQPGRSLRLSCAASGFMFSSYGMHWVRQAPGKGLEWVAVIWYDGSNKYYADSVKGRFTISRDNSKNTLYLQMNSLRAEDTAVYYCARDGLNWNVPHYGMDVWGQGTTVTVSS

SEQ ID NO: 1792 - protein, 16 aa, Artificial Sequence
  Description of Artificial Sequence: Synthetic peptide
ARDGLNWNVPHYGMDV

SEQ ID NO: 1793 - protein, 108 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSFPPLTFGGGTKVEIK

SEQ ID NO: 1794 - protein, 10 aa, Artificial Sequence
  Description of Artificial Sequence: Synthetic peptide
QQANSFPPLT

SEQ ID NO: 1795 - protein, 125 aa, Artificial Sequence
  Description of Artificial Sequence: Synthetic polypeptide
QVQLVESGGGVVQPGRSLRLSCAASGFTFSTYGMHWVRQAPGKGLEWVAVISYDGSNKYFADSVKGRFTISRDNSKNTLYLQMNSLRPEDTAVYYCAKVGMEYSSGWYGEEIDFWGQGTLVTVSS

SEQ ID NO: 1796 - protein, 18 aa, Artificial Sequence
  Description of Artificial Sequence: Synthetic peptide
AKVGMEYSSGWYGEEIDF

SEQ ID NO: 1797 - protein, 107 aa, Artificial Sequence
  Description of Artificial Sequence: Synthetic polypeptide
DIQMTQSPSSLSASVGDRVTITCRASQSISSYLNWYQQKPGKVPKLLIYAASSLQSGVPSRFSGSGSGTDFTLTISSLQPEDFATYYCQQSYRTPLTFGGGTKVEIK

SEQ ID NO: 1798 - protein, 9 aa, Artificial Sequence
  Description of Artificial Sequence: Synthetic peptide
QQSYRTPLT

SEQ ID NO: 1799 - protein, 123 aa, Artificial Sequence
  Description of Artificial Sequence: Synthetic polypeptide
EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCARDLRDQDGYSYGAFDYWGQGTLVTVSS

SEQ ID NO: 1800 - protein, 17 aa, Artificial Sequence
  Description of Artificial Sequence: Synthetic peptide
ARDLRDQDGYSYGAFDY

SEQ ID NO: 1801 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSSWVFGGGTKLTVL

SEQ ID NO: 1802 - protein, 10 aa, Artificial Sequence
  Description of Artificial Sequence: Synthetic peptide
SSYTSSSSWV

SEQ ID NO: 1803 - protein, 121 aa, Artificial Sequence
  Description of Artificial Sequence: Synthetic polypeptide
  MOD_RES (45)..(45): Any amino acid
  MOD_RES (61)..(61): Any amino acid
  MOD_RES (72)..(72): Any amino acid
EVQLVESGGGLVKPGGSLRLSCAVSGFTFSNVWMRWVRQAPGKGXEWVGRIKSKTDGGTTXYAAPVKGRFTXSRDDSKNTLYLQMNSLKTEDTAVYYCTSQVWLRGPGDYWGQGTLVTVSS

SEQ ID NO: 1804 - protein, 12 aa, Artificial Sequence
  Description of Artificial Sequence: Synthetic peptide
TSQVWLRGPGDY

SEQ ID NO: 1805 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSLNWVFGGGTKLTVL

SEQ ID NO: 1806 - protein, 10 aa, Artificial Sequence
  Description of Artificial Sequence: Synthetic peptide
QSYDSSLNWV

SEQ ID NO: 1807 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKHYADSVKGRFTISRDNSKNTLYLQMNSLRAEDTAVYYCAKDPWELRQGNYFDYWGQGTLVTVSS

SEQ ID NO: 1808 - protein, 15 aa, Artificial Sequence
  Description of Artificial Sequence: Synthetic peptide
AKDPWELRQGNYFDY

SEQ ID NO: 1809 - protein, 108 aa, Artificial Sequence
  Description of Artificial Sequence: Synthetic polypeptide
SYVLTQPPSVSVAPGQTARITCGGNNIGSKNVHWYQQKPGQAPVLVVYDDSDRPSGIPERFSGSNSGTTATLTISRVEAGDEADYYCQVWDSSSDPWVFGGGTKLTVL

SEQ ID NO: 1810 - protein, 11 aa, Artificial Sequence
  Description of Artificial Sequence: Synthetic peptide
QVWDSSSDPWV

SEQ ID NO: 1811 - protein, 125 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDSAYSGYDFFEAPRDYWGQGTLVTVSS

SEQ ID NO: 1812 - protein, 18 aa, Artificial Sequence
  Description of Artificial Sequence: Synthetic peptide
ARDSAYSGYDFFEAPRDY

SEQ ID NO: 1813 - protein, 106 aa, Artificial Sequence
  Description of Artificial Sequence: Synthetic polypeptide
DIQMTQSPSSLSASVGDRVTITCRASQSISSFLNWYQQKPGKAPKLLIYAASSLHSGVPSRFSGSGSGTDFTLTISSLQPEDFATYYCQQSYRTPPLFGGGTKVEI

SEQ ID NO: 1814 - protein, 9 aa, Artificial Sequence
  Description of Artificial Sequence: Synthetic peptide
QQSYRTPPL

SEQ ID NO: 1815 - protein, 120 aa, Artificial Sequence
  Description of Artificial Sequence: Synthetic polypeptide
EVQLVESGGGLVKPGGSLRLSCAASGLTFTAYRMNWVRQAPGKGLEWLSSISNTNGDIYYADSVKGRFTISRDNAKNSLYLQMNSLRADDTAVYYCARDVASNYAYFDLWGQGTLVTVSS

SEQ ID NO: 1816 - protein, 13 aa, Artificial Sequence
  Description of Artificial Sequence: Synthetic peptide
ARDVASNYAYFDL

SEQ ID NO: 1817 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPLTFGGGTKVEIK

SEQ ID NO: 1818 - protein, 10 aa, Artificial Sequence
  Description of Artificial Sequence: Synthetic peptide
QQSYSTPPLT

SEQ ID NO: 1819 - protein, 127 aa, Artificial Sequence
  Description of Artificial Sequence: Synthetic polypeptide
QVQLVESGGGVVQPGRSLRLSCAASGFTFSRYGMHWVRQAPGKGLEWVAVMSYDGSSKYYADSVKGRFTISRDNSKNTLCLQMNSLRAEDTAVYYCAKQAGPYCSGGSCYSAPFDYWGQGTLVTVSS

SEQ ID NO: 1820 - protein, 20 aa, Artificial Sequence
  Description of Artificial Sequence: Synthetic peptide
AKQAGPYCSGGSCYSAPFDY

SEQ ID NO: 1821 - protein, 107 aa, Artificial Sequence
  Description of Artificial Sequence: Synthetic polypeptide
DIQMTQSPSSLSASVGDRVTITCQASQGISNYLNWYQQKPGKAPKLLIYDASNLETGVPSRFSGSGSGTDFTFTISSLQPEDIATYYCQQYDNLPITFGQGTRLEIK

SEQ ID NO: 1822 - protein, 9 aa, Artificial Sequence
  Description of Artificial Sequence: Synthetic peptide
QQYDNLPIT

SEQ ID NO: 1823 - protein, 117 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDRVIYGMDVWGQGTTVTVSS

SEQ ID NO: 1824 - protein, 11 aa, Artificial Sequence
  Description of Artificial Sequence: Synthetic peptide
ARDRVIYGMDV

SEQ ID NO: 1825 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPQTFGGGTKVEIK

SEQ ID NO: 1826 - protein, 9 aa, Artificial Sequence
  Description of Artificial Sequence: Synthetic peptide
QQYDNLPQT

SEQ ID NO: 1827 - protein, 129 aa, Artificial Sequence
  Description of Artificial Sequence: Synthetic polypeptide
EVQLVESGGGLVQPGGSLRLSCAASGFSVSTKYMTWVRQAPGKGLEWVSALYSGGSDYYADSVKGRFTISRDNSKNTLYLQMSSLRVEDTGVYYCARDSSEVRDHPGHPGRSVGAFDIWGQGTMVTVSS

SEQ ID NO: 1828 - protein, 23 aa, Artificial Sequence
  Description of Artificial Sequence: Synthetic peptide
ARDSSEVRDHPGHPGRSVGAFDI

SEQ ID NO: 1829 - protein, 110 aa, Artificial Sequence
  Description of Artificial Sequence: Synthetic polypeptide
QSALTQPASVSGSPGQSITISCTGTSNDVGSYTLVSWYQQYPGKAPKLLIFEDTKRSSGISNRFSGSKSGNTASLTISGLQGEDEADYYCCSYAGTSTFVFGGGTKLTVL

SEQ ID NO: 1830 - protein, 10 aa, Artificial Sequence
  Description of Artificial Sequence: Synthetic peptide
CSYAGTSTFV

SEQ ID NO: 1831 - protein, 125 aa, Artificial Sequence
  Description of Artificial Sequence: Synthetic polypeptide
EVQLVESGGGLVQPGGSLRLSCAASGFSVSTKYMTWVRQAPGKGLEWVSALYSGGSDYYADSVKGRFTISRDNSKNTLYLQMSSLRVEDTGVYYCARDSSEVRDHPGHPGRSVGAFDIWGQGTMV

SEQ ID NO: 1832 - protein, 23 aa, Artificial Sequence
  Description of Artificial Sequence: Synthetic peptide
ARDSSEVRDHPGHPGRSVGAFDI

SEQ ID NO: 1833 - protein, 113 aa, Artificial Sequence
  Description of Artificial Sequence: Synthetic polypeptide
  MOD_RES (15)..(15): Any amino acid
DIVMTQSPDSLAVSXGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 1834 - protein, 9 aa, Artificial Sequence
  Description of Artificial Sequence: Synthetic peptide
QQYYSTPLT

SEQ ID NO: 1835 - protein, 115 aa, Artificial Sequence
  Description of Artificial Sequence: Synthetic polypeptide
EVQLVESGGGLVQPGGSQRLSCAASGFTVSSNYMSWIRQAPGKGLEWVSVIYSGGSAYYVDSVKGRFTISRDNSKNTLYLQMNSLRAEDTAVYYCARIANYMDVWGKGTTVTVSS

SEQ ID NO: 1836 - protein, 9 aa, Artificial Sequence
  Description of Artificial Sequence: Synthetic peptide
ARIANYMDV

SEQ ID NO: 1837 - protein, 108 aa, Artificial Sequence; identical to SEQ ID NO: 20
  Description of Artificial Sequence: Synthetic polypeptide

SEQ ID NO: 1838 - protein, 10 aa, Artificial Sequence
  Description of Artificial Sequence: Synthetic peptide
QQYNNWPPLT

SEQ ID NO: 1839 - protein, 130 aa, Artificial Sequence
  Description of Artificial Sequence: Synthetic polypeptide
QVQLVQSGAEVKKPGASVKVSCKASGYNFTSYGISWVRQAPGQGLEWMGWISGYNGNTNYGQKFQGGVTMTTDTSTSTAYMELRSLRSDDTAVYYCARDRGGHNFWSGYGYYYYYGMDVWGQGTTVTVSS

SEQ ID NO: 1840 - protein, 23 aa, Artificial Sequence
  Description of Artificial Sequence: Synthetic peptide
ARDRGGHNFWSGYGYYYYYGMDV

SEQ ID NO: 1841 - protein, 107 aa, Artificial Sequence
  Description of Artificial Sequence: Synthetic polypeptide
  MOD_RES (12)..(12): Any amino acid
DIQMTQSPSSLXASVGDRVTITCRASQGISNYLAWYQQKPGKVPKLLIYAASTLQSGVPSRFSGSESGTDFTLTISSLQPEDVATYYCQKYNSAPRTFGQGTKVEIK

SEQ ID NO: 1842 - protein, 9 aa, Artificial Sequence
  Description of Artificial Sequence: Synthetic peptide
QKYNSAPRT

SEQ ID NO: 1843 - protein, 120 aa, Artificial Sequence
  Description of Artificial Sequence: Synthetic polypeptide
EVQLVESGGGLVQPGRSLRLSCTGSEFTFGDFSMSWFRQAPGKGLEWVGFIRRKADGGTTEYAASVRGRFTISRDDSKSIAYLVMNSLKSEDTAVYYCTRAWIPTPHDYWGQGVLVTVSS

SEQ ID NO: 1844 - protein, 11 aa, Artificial Sequence
  Description of Artificial Sequence: Synthetic peptide
TRAWIPTPHDY

SEQ ID NO: 1845 - protein, 109 aa, Artificial Sequence
  Description of Artificial Sequence: Synthetic polypeptide
QSVLTQPPSASGTPGQRVTISCSGSSSNIGSNPVNWYQQLPGTAPKLLIYSNNRRPSGVPDRFSGSKSGASASLAISGLQSEDEAAYYCAAWDDSRKGPVFGGGTKLTV

SEQ ID NO: 1846 - protein, 11 aa, Artificial Sequence
  Description of Artificial Sequence: Synthetic peptide
AAWDDSRKGPV

SEQ ID NO: 1847 - protein, 127 aa, Artificial Sequence
  Description of Artificial Sequence: Synthetic polypeptide
  MOD_RES (22)..(22): Any amino acid
QVQLVESGGGVVQPGRSLRLSXAASGFTFSTYGMHWVRQAPGKGLEWVAVISYDGSDKYYADSVKGRFAISRDNSKNTLFLQMNSLRAEDTAVYYCAKPLGRYCSSTNCLRGYLDYWGQGTLVTVSS

SEQ ID NO: 1848 - protein, 20 aa, Artificial Sequence
  Description of Artificial Sequence: Synthetic peptide
AKPLGRYCSSTNCLRGYLDY

SEQ ID NO: 1849 - protein, 111 aa, Artificial Sequence
  Description of Artificial Sequence: Synthetic polypeptide
QSVLTQPASVSGSPGQSITISCTGTSSDVGSYNLVSWYQQHSGKAPKLMIYEISKRPSGISNRFSGSKSGNTASLTISGLQAEDEADYYCCSYADNHTPVVFGGGTKLTVL

SEQ ID NO: 1850 - protein, 11 aa, Artificial Sequence
  Description of Artificial Sequence: Synthetic peptide
CSYADNHTPVV

SEQ ID NO: 1851 - protein, 119 aa, Artificial Sequence
  Description of Artificial Sequence: Synthetic polypeptide
QVQLVESGGGVVQPGGSLRLSCAASLFSFSDYGMHWVRQAPGKGLEWVAFIWYDGTKKDYTHSVKGRFTVSRDNSKNTLYLQMNSLRAEDTAMYYCAKARGFQHYFDQWGQGTLVTVSS

SEQ ID NO: 1852 - protein, 12 aa, Artificial Sequence
  Description of Artificial Sequence: Synthetic peptide
AKARGFQHYFDQ

SEQ ID NO: 1853 - protein, 112 aa, Artificial Sequence
  Description of Artificial Sequence: Synthetic polypeptide
QSVLTQPASVSGSPGQSITISCTGTSSDVGSYNLVSWYQQHPGKAPKLLIYEVGKRPSGVSNRFSGSKSGNTASLTISGLQAEDEADYYCCSYAGSGTLGVVFGGGTKLTVL

SEQ ID NO: 1854 - protein, 12 aa, Artificial Sequence
  Description of Artificial Sequence: Synthetic peptide
CSYAGSGTLGVV

SEQ ID NO: 1855 - protein, 119 aa, Artificial Sequence
  Description of Artificial Sequence: Synthetic polypeptide
QVQLQESGPGLEKPSETLSLTCTVSGGSISSYYWSWIRQPPGKGLEWIGYVHYSGSTKYNPSLKSRVTISVDTSKTQFSLNLSSVTAADTAVYYCARDTGPYYYGMDVWGQGTTVTVSS

SEQ ID NO: 1856 - protein, 13 aa, Artificial Sequence
  Description of Artificial Sequence: Synthetic peptide
ARDTGPYYYGMDV

SEQ ID NO: 1857 - protein, 109 aa, Artificial Sequence
  Description of Artificial Sequence: Synthetic polypeptide
QSVLTQPRSVSGSPGQSVTISCTGTSSDVGGYDYVSWYQQHPGKAPKLIIYDVTKRPSGVPDRFSGSKSGNTASLTISGLQTEDEADYSCGSYAGSFRIFGGGTKLTVL

SEQ ID NO: 1858 - protein, 9 aa, Artificial Sequence
  Description of Artificial Sequence: Synthetic peptide
GSYAGSFRI

SEQ ID NO: 1859 - protein, 122 aa, Artificial Sequence; identical to SEQ ID NO: 197
  Description of Artificial Sequence: Synthetic polypeptide

SEQ ID NO: 1860 - protein, 15 aa, Artificial Sequence
  Description of Artificial Sequence: Synthetic peptide
ARHYDILTSLSWFDP

SEQ ID NO: 1861 - protein, 111 aa, Artificial Sequence; identical to SEQ ID NO: 198
  Description of Artificial Sequence: Synthetic polypeptide

SEQ ID NO: 1862 - protein, 12 aa, Artificial Sequence
  Description of Artificial Sequence: Synthetic peptide
GTWDSSLSANWV

SEQ ID NO: 1863 - protein, 132 aa, Artificial Sequence
  Description of Artificial Sequence: Synthetic polypeptide
QVQLVESGGGVVQPGRSLRLSCAASGFTFRSYGMHWVRQAPGKGLEWVAVISYDGSNKYYADSVKGRFTISRDNSKNTLYLQMNSLRAEDTAVYYCAKSEGQYCSGGSCSSADYYYYGMDVWGQGTTVTVSS

SEQ ID NO: 1864 - protein, 25 aa, Artificial Sequence
  Description of Artificial Sequence: Synthetic peptide
AKSEGQYCSGGSCSSADYYYYGMDV

SEQ ID NO: 1865 - protein, 110 aa, Artificial Sequence
  Description of Artificial Sequence: Synthetic polypeptide
QSVLTQEPSLTVSPGGTVTLTCGSSTGVVTSGHYPYWFQQKPGQAPRTLIYDTSNKHSWTPARFSGSLLGGKAALTLSGAQPEDEAEYYCLLSYSGARPVFGGGTKLTVL

SEQ ID NO: 1866 - protein, 10 aa, Artificial Sequence
  Description of Artificial Sequence: Synthetic peptide
LLSYSGARPV

SEQ ID NO: 1867 - protein, 129 aa, Artificial Sequence
  Description of Artificial Sequence: Synthetic polypeptide
QVQLVESGGGVVQPGRSLRLSCAASGFTFSSYGLHWVRQAPGKGLEWVALISSDGTNKYYADSVKGRFTISRDNSKKTEYLQMNSLRAEDTAVYYCAKDLTDTSGWDDDYYYYYGMDAWGQGTTVTVSS

SEQ ID NO: 1868 - protein, 22 aa, Artificial Sequence
  Description of Artificial Sequence: Synthetic peptide
AKDLTDTSGWDDDYYYYYGMDA

SEQ ID NO: 1869 - protein, 105 aa, Artificial Sequence
  Description of Artificial Sequence: Synthetic polypeptide
SYVLTQPPSVSVSPGQTASITCSGDKLGEKSASWYQQKPGQSPVLVIYRDTERPSGIPERFSGSNSGTTATLTISGALAMDEAEYYCQAWDKSTVVFGGGTTLTV

SEQ ID NO: 1870 - protein, 9 aa, Artificial Sequence
  Description of Artificial Sequence: Synthetic peptide
QAWDKSTVV

SEQ ID NO: 1871 - protein, 131 aa, Artificial Sequence
  Description of Artificial Sequence: Synthetic polypeptide
QVQLQQSGPGLLKPSQTLSLTCAISGDSVSSSGAAWNWIRQSPSRGLEWLGRTYYKSKWYNDYAVSVKSRITINPDTSKNQFSLQLNSVTPEDTAVYYCARMWVVAGTTDDYYYHYGMDVWGQGTTVTVSS

SEQ ID NO: 1872 - protein, 21 aa, Artificial Sequence
  Description of Artificial Sequence: Synthetic peptide
ARMWVVAGTTDDYYYHYGMDV

SEQ ID NO: 1873 - protein, 108 aa, Artificial Sequence
  Description of Artificial Sequence: Synthetic polypeptide
SYVLTQPPSVSVSPGQTARITCSGNALPKQYVYWYQQKPGQAPVLVIYKDSERPSGIPERFSGSSSGTTVTLTISGVQAEDEAEYYCQSADSTGTYVIFGGGTKLTVL

SEQ ID NO: 1874 - protein, 11 aa, Artificial Sequence
  Description of Artificial Sequence: Synthetic peptide
QSADSTGTYVI

SEQ ID NO: 1875 - protein, 124 aa, Artificial Sequence
  Description of Artificial Sequence: Synthetic polypeptide
QVQLVQSGAEVKRPGSSVKVSCQASGGTSSSYTISWVRQAPGQGLEWMGRIIPILGVANYAQKFQGGVTISADKSTGTAYMELSSLRSEDTAVYYCARETGYSGHLAVSYMDVWGKGTTVTVSS

SEQ ID NO: 1876 - protein, 17 aa, Artificial Sequence
  Description of Artificial Sequence: Synthetic peptide
ARETGYSGHLAVSYMDV

SEQ ID NO: 1877 - protein, 110 aa, Artificial Sequence
  Description of Artificial Sequence: Synthetic polypeptide
NFMLTQPHSVSESPGKTVTISCSGSSGSIASNYVQWYQQRPGSAPTTVIYEDNQRPSGVPDRFSGSIDSSSNSASLTISGLKTEDEADYYCQSFDSNTWVFGGGTKLTVL

SEQ ID NO: 1878 - protein, 9 aa, Artificial Sequence
  Description of Artificial Sequence: Synthetic peptide
QSFDSNTWV

SEQ ID NO: 1879 - protein, 119 aa, Artificial Sequence
  Description of Artificial Sequence: Synthetic polypeptide
EVQLVQSGAEVKKPGESLNISCKASGYSFTIYWIAWVRQLPGKGLEWMGIIYPGDSDTRYSPSFQGQVTISADKSISTAYLQWRSLKASDSAVYYCARGVAVDWYFDLWGRGTLVSVSS

SEQ ID NO: 1880 - protein, 12 aa, Artificial Sequence
  Description of Artificial Sequence: Synthetic peptide
ARGVAVDWYFDL

SEQ ID NO: 1881 - protein, 112 aa, Artificial Sequence; identical to SEQ ID NO: 190
  Description of Artificial Sequence: Synthetic polypeptide

SEQ ID NO: 1882 - protein, 12 aa, Artificial Sequence
  Description of Artificial Sequence: Synthetic peptide
QSSGSVLSDLYV

SEQ ID NO: 1883 - protein, 123 aa, Artificial Sequence
  Description of Artificial Sequence: Synthetic polypeptide
  MOD_RES (54)..(55): Any amino acid
QVQLVQSGAEVKKPGSSVKVSCKASGGSFTNHFISWVRQAPGQGLEWMGRIIPXXGTANYAQNFQGRVMMTADKSTSTAYMELSSLRSEDTAVYYCARDSGYSGYGSTYYMDVWGKGTSVTVS

SEQ ID NO: 1884 - protein, 17 aa, Artificial Sequence
  Description of Artificial Sequence: Synthetic peptide
ARDSGYSGYGSTYYMDV

SEQ ID NO: 1885 - protein, 111 aa, Artificial Sequence; identical to SEQ ID NO: 194
  Description of Artificial Sequence: Synthetic polypeptide

SEQ ID NO: 1886 - protein, 11 aa, Artificial Sequence
  Description of Artificial Sequence: Synthetic peptide
QSYDSSLSDSV

SEQ ID NO: 1887 - protein, 124 aa, Artificial Sequence; identical to SEQ ID NO: 1875
  Description of Artificial Sequence: Synthetic polypeptide

SEQ ID NO: 1888 - protein, 17 aa, Artificial Sequence
  Description of Artificial Sequence: Synthetic peptide
ARETGYSGHLAVSYMDV

SEQ ID NO: 1889 - protein, 111 aa, Artificial Sequence
  Description of Artificial Sequence: Synthetic polypeptide
QSVLTQPPSVSGAPGQRVTFSCTGTNSNIGAGYDVHWYQQLPGTAPKLLIYGNNNRPSGVADRFSGSKSGTSASLAITGLQAEDEADYYCQSYDSSLSDSVFGGGTKLTVL

SEQ ID NO: 1890 - protein, 11 aa, Artificial Sequence
  Description of Artificial Sequence: Synthetic peptide
QSYDSSLSDSV

SEQ ID NO: 1891 - protein, 124 aa, Artificial Sequence
  Description of Artificial Sequence: Synthetic polypeptide
QVQLVQSGAEVKKPGSSVKVSCKASGGTFSSYPISWVRQAPGQGLEWMGRVIPILGITNYAEKYQGGVTISADKSTSTAYMELSRLTSEDTAVYYCARDMGYSGSGSSYYMDVWGRGTTVTVSS

SEQ ID NO: 1892 - protein, 17 aa, Artificial Sequence
  Description of Artificial Sequence: Synthetic peptide
ARDMGYSGSGSSYYMDV

SEQ ID NO: 1893 - protein, 111 aa, Artificial Sequence
  Description of Artificial Sequence: Synthetic polypeptide
QSVLTQPPSVSGAPGQRVTISCTGSSSNIGAGYDVHWYQQLPGTAPKLLIYVNTNRPSGVPDRFSGSKSGTSASLAITGLQAEDEADYYCQSYDSSLSGGVFGGGTKLTVL

SEQ ID NO: 1894 - protein, 11 aa, Artificial Sequence
  Description of Artificial Sequence: Synthetic peptide
QSYDSSLSGGV

SEQ ID NO: 1895 - protein, 119 aa, Artificial Sequence
  Description of Artificial Sequence: Synthetic polypeptide
EVQLVESGGGLVQPGGSQRLSCAASGFLFSSYWMSWVRQAPGKGLEWVANIKQDGSEKYYVDSVKGRFTISRDNAKNSLYLQMNSLRAEDTAVYFCAGSQWLRGAFEIWGQGTMVTVSS

SEQ ID NO: 1896 - protein, 12 aa, Artificial Sequence
  Description of Artificial Sequence: Synthetic peptide
AGSQWLRGAFEI

SEQ ID NO: 1897 - protein, 110 aa, Artificial Sequence
  Description of Artificial Sequence: Synthetic polypeptide
NFMLTQPHSVSESPGKTVTISCTRSSGSIAGNYVQWYQQRPGSSPTTVIYEDNQRPSGVPDRFSGSIDSSSNSASLTISGLKTEDEADYYCQSYDSSNWVFGGGTKLTVL

SEQ ID NO: 1898 - protein, 9 aa, Artificial Sequence
  Description of Artificial Sequence: Synthetic peptide
QSYDSSNWV

SEQ ID NO: 1899 - protein, 121 aa, Artificial Sequence
  Description of Artificial Sequence: Synthetic polypeptide
QVQLVQSGAEVKKPGASVKVSCKASGYTFSGYGISWVRQAPGQGLEWMGWVSAYNGNTNYAQKLQGRVTMTTDTSTSTAYMELRSLRFDDTAVYYCVGGMVAAAGWGVSAWGQGTPVIVSS

SEQ ID NO: 1900 - protein, 14 aa, Artificial Sequence
  Description of Artificial Sequence: Synthetic peptide
VGGMVAAAGWGVSA

SEQ ID NO: 1901 - protein, 110 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYGSRFWVFGGGTKLTVL

SEQ ID NO: 1902 - protein, 9 aa, Artificial Sequence
  Description of Artificial Sequence: Synthetic peptide
QSYGSRFWV

SEQ ID NO: 1903 - protein, 122 aa, Artificial Sequence
  Description of Artificial Sequence: Synthetic polypeptide
QVQLQESGPGLVKPSQTLSLTCTVSGGSISSGGYFWSWIRQHPGKGLEWLGYNYYTGTPHYNPSLKSRLVISIDTSKNQFSLKLSSVTAADTAVYYCARGDTFGRGYYFDYWGQGTLVTVSP

SEQ ID NO: 1904 - protein, 14 aa, Artificial Sequence
  Description of Artificial Sequence: Synthetic peptide
ARGDTFGRGYYFDY

SEQ ID NO: 1905 - protein, 109 aa, Artificial Sequence
  Description of Artificial Sequence: Synthetic polypeptide
SYVLTQPPSVSVAPGQTARITCGGNNIGSKSVHWYQQKPGQAPVMVVYDDSDRPSGIPERFSGSNSGDTATLTISRVEAGDEADYSCQVWDRSSDHPWVFGGGTKLTVL

SEQ ID NO: 1906 - protein, 12 aa, Artificial Sequence
  Description of Artificial Sequence: Synthetic peptide
QVWDRSSDHPWV

SEQ ID NO: 1907 - protein, 119 aa, Artificial Sequence
  Description of Artificial Sequence: Synthetic polypeptide
EVQLVESGGGLVQPGGSLRLSCAASGFTFSGYVMHWVRQAPGEGLEYVSTVGGDGGSPYYANSVKGRFSISRDNSKNTLYLQMGSLRGDDTAVYFCAREKSLTGAFDIWGQGTMVTVSS

SEQ ID NO: 1908 - protein, 12 aa, Artificial Sequence
  Description of Artificial Sequence: Synthetic peptide
AREKSLTGAFDI

SEQ ID NO: 1909 - protein, 108 aa, Artificial Sequence
  Description of Artificial Sequence: Synthetic polypeptide
SYVLTQPPSVSVAPGQPARIPCGGNNIGSKSVHWYQQKPGQAPVLVVYDDSDRPSGIPERFSGSNSGNTATLTISRVEAGDEADYYCQVWDSSPDHYVFGTGTKVTVL

SEQ ID NO: 1910 - protein, 11 aa, Artificial Sequence
  Description of Artificial Sequence: Synthetic peptide
QVWDSSPDHYV

SEQ ID NO: 1911 - protein, 119 aa, Artificial Sequence; identical to SEQ ID NO: 183
  Description of Artificial Sequence: Synthetic polypeptide

SEQ ID NO: 1912 - protein, 12 aa, Artificial Sequence
  Description of Artificial Sequence: Synthetic peptide
AREGALTNWFDP

SEQ ID NO: 1913 - protein, 109 aa, Artificial Sequence
  Description of Artificial Sequence: Synthetic polypeptide
SYVLTQPPSVSVAPGQTARIPCGGNNIGSKSVHWYQQKPGQAPVLVVYDDSDRPSGIPERFSGSNSGNTATLTISRVEAGDEADYYCQVWDSSSDLHVVFGGGTKLTVL

SEQ ID NO: 1914 - protein, 12 aa, Artificial Sequence
  Description of Artificial Sequence: Synthetic peptide
QVWDSSSDLHVV

SEQ ID NO: 1915 - protein, 121 aa, Artificial Sequence
  Description of Artificial Sequence: Synthetic polypeptide
EVQLVESGGGLVQPGRSLRLSCVASGFTFDDYAMHWVRQAPGKGLEWVSGISWNSGSIGYADSVKGRFTISRDNAKNSLYLQMNSLRAEDTALYYCAKSGGVDWTWTLHYWGQGTLVTVSS

SEQ ID NO: 1916 - protein, 14 aa, Artificial Sequence
  Description of Artificial Sequence: Synthetic peptide
AKSGGVDWTWTLHY

SEQ ID NO: 1917 - protein, 109 aa, Artificial Sequence
  Description of Artificial Sequence: Synthetic polypeptide
SYVLTQPPSVSVAPGQTARITCGGNNIGSKSVHWYQQKPGQAPVLVVYDDSDRPSGIPERFSGSNSGNTATLTISRVEAGDEADYYSQVWDTSSDHPVIFGGGTKLTVL

SEQ ID NO: 1918 - protein, 12 aa, Artificial Sequence
  Description of Artificial Sequence: Synthetic peptide
QVWDTSSDHPVI

SEQ ID NO: 1919 - protein, 117 aa, Artificial Sequence
  Description of Artificial Sequence: Synthetic polypeptide
EVQLVESGGGVVQPGGSLRLSCAASGFTVSSNFMSWVRQAPGKGLEWVSLIYNSGSTYYADSVKGRFTISRDKSKNSLYLQMNSLRAEDTAVYYCANQGYYYYMDVWGKGTPVTVSS

SEQ ID NO: 1920 - protein, 11 aa, Artificial Sequence
  Description of Artificial Sequence: Synthetic peptide
ANQGYYYYMDV

SEQ ID NO: 1921 - protein, 111 aa, Artificial Sequence
  Description of Artificial Sequence: Synthetic polypeptide
QSALTQPASVSGSPGQSITISCTGTSSDVGGYNYVSWYQHHPGKAPKLMIYDVSYRPSGVSNRFSGSKSGNTASLTISGLQSEDEADYYCSSYTSGSTPWVFGGGTKLTVL

SEQ ID NO: 1922 - protein, 11 aa, Artificial Sequence
  Description of Artificial Sequence: Synthetic peptide
SSYTSGSTPWV

SEQ ID NO: 1923 - protein, 116 aa, Artificial Sequence
  Description of Artificial Sequence: Synthetic polypeptide
EVQLVESGGGLVRPGGSLTLSCVASGFTVGSNFMSWVRQAPGKGLEWVSLIYNSGGTHYADSVKGRFTISRDRSKNTLYLQMNSLRAEDTAIYYCANHGYYYYMDVWGKGTAVTVS

SEQ ID NO: 1924 - protein, 11 aa, Artificial Sequence
  Description of Artificial Sequence: Synthetic peptide
ANHGYYYYMDV

SEQ ID NO: 1925 - protein, 111 aa, Artificial Sequence
  Description of Artificial Sequence: Synthetic polypeptide
QSVLTQPASVSGSPGQSITISCTGTGSDIGAYNYVSWHQHHPGKAPKLIIYDVSNRPSGVSNRFSGSKSGNTASLTISGLQAEDEADYYCTSYTNTTTPWVFGGGTKVTVL

SEQ ID NO: 1926 - protein, 11 aa, Artificial Sequence
  Description of Artificial Sequence: Synthetic peptide
TSYTNTTTPWV

SEQ ID NO: 1927 - protein, 120 aa, Artificial Sequence
  Description of Artificial Sequence: Synthetic polypeptide
EVQLVESGGGLVQPGGSLRLSCAASGFTFSSYSMNWVRQAPGKGLEWISYISSGSSTIHYSDSVQGRFTVSRDNAKNSLYLQMNSLRDEDTAVYYCCAARLYYHYYMDVWGKGTTVTVSS

SEQ ID NO: 1928 - protein, 13 aa, Artificial Sequence
  Description of Artificial Sequence: Synthetic peptide
CAARLYYHYYMDV

SEQ ID NO: 1929 - protein, 108 aa, Artificial Sequence
  Description of Artificial Sequence: Synthetic polypeptide
QSVLTQPASVSGSPGQSITISCTGTSSDVGSYDLVSWFQQHPGKAPKLMIYEVNKRPSGVSDRFSGSKSGNTASLTIFGLQAEDEADYYCCSYVGTSIFGTGTKVTVL

SEQ ID NO: 1930 - skipped

SEQ ID NO: 1931 - protein, 127 aa, Artificial Sequence
  Description of Artificial Sequence: Synthetic polypeptide
EVQLVESGGGLVQPGGSLRLSCEASGITFSGYSMNWVRQAPGKGLEWVSYISSGSSTVHYADSVKGRFTISRDNAKNSLYLQMNSLRVEDTAVYYCARDRRYTIGQVDHYYYAMDVWGQGTTVTVSS

SEQ ID NO: 1932 - protein, 20 aa, Artificial Sequence
  Description of Artificial Sequence: Synthetic peptide
ARDRRYTIGQVDHYYYAMDV

SEQ ID NO: 1933 - protein, 108 aa, Artificial Sequence
  Description of Artificial Sequence: Synthetic polypeptide
QSALTQPRSVSGSPGQSVTISCTGTSSDVGDYGYVSWYQQHPDKAPKLIIYDVNKWPSGVPDRFSGSKSGITASLTISGLQADDEADYYCCSYAGYYIFGTGTKVTVL

SEQ ID NO: 1934 - skipped

SEQ ID NO: 1935 - protein, 117 aa, Artificial Sequence
  Description of Artificial Sequence: Synthetic polypeptide
EVQLVESGGGLVQPGGSLRLSCAASGIIVSNNYMSWVRQAPGKGLEWVSTIFSGGSTYYADSVKDRFTISRDNSNNTLYLQMNSLRPEDTAVYYCTRLGGYRYGMDVWGQGTTVTVS

SEQ ID NO: 1936 - protein, 12 aa, Artificial Sequence
  Description of Artificial Sequence: Synthetic peptide
TRLGGYRYGMDV

SEQ ID NO: 1937 - protein, 107 aa, Artificial Sequence
  Description of Artificial Sequence: Synthetic polypeptide
DIQMTQSPSSLSASVGDRVTITCQASQDISKYLNWYQQKPGTAPKLLIYDASELERGVPSRFSGSGSGTDFTFTIISLQPEDIATYYCLQYDNLPYTFGQGTKLQIK

SEQ ID NO: 1938 - protein, 9 aa, Artificial Sequence
  Description of Artificial Sequence: Synthetic peptide
LQYDNLPYT

SEQ ID NO: 1939 - protein, 126 aa, Artificial Sequence
  Description of Artificial Sequence: Synthetic polypeptide
EVQLVESGGGLVQPGRSLKLSCVVSGFSFDDYAMHWVRQGPGKGLQWVSGLSWNSDSIGYADSVKGRFTISRDNAKNSLYLQMNSLRAEDTALYYCVKDTRAHYDILAGYNGMDVWGQGTTVTVSS

SEQ ID NO: 1940 - protein, 19 aa, Artificial Sequence
  Description of Artificial Sequence: Synthetic peptide
VKDTRAHYDILAGYNGMDV

SEQ ID NO: 1941 - protein, 111 aa, Artificial Sequence
  Description of Artificial Sequence: Synthetic polypeptide
DIVMTQSPLSLPVTPGEPASISCRSSQSLLHSNGYNYLDWYLQRPGQSPQLLIYLGSNRASGVPDRFSGSGSGTDFTLKISRVEAEDVGIYYCMQVLQTPGFGGGTKVEIK

SEQ ID NO: 1942 - protein, 8 aa, Artificial Sequence
  Description of Artificial Sequence: Synthetic peptide
MQVLQTPG

SEQ ID NO: 1943 - protein, 117 aa, Artificial Sequence
  Description of Artificial Sequence: Synthetic polypeptide
EVQLVESGGNLVQPGGSLRLSCAASGVTVSSNYMTWVRQAPGKGLEWVSVIYSGGSTFYADSVKGRFTISRDNSKNTVYLQMKSLRAEDTAVYYCARDLYYYGMDVWGQGTTVTVSS

SEQ ID NO: 1944 - protein, 11 aa, Artificial Sequence
  Description of Artificial Sequence: Synthetic peptide
ARDLYYYGMDV

SEQ ID NO: 1945 - protein, 106 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQELNSYPSFGQGTKLEIK

SEQ ID NO: 1946 - protein, 8 aa, Artificial Sequence
  Description of Artificial Sequence: Synthetic peptide
QELNSYPS

SEQ ID NO: 1947 - protein, 120 aa, Artificial Sequence
  Description of Artificial Sequence: Synthetic polypeptide
QVQLVESGGGVVQPGGSLRLSCVASGFEFRDYGMHWVRQAPGKGLHWVAIVQSDGKNIYYADSVKGRFTISRDNSKRSQYLQMNSLRPEDTAVYYCAKENYRGTGYLESWGQGTLVTVSS

SEQ ID NO: 1948 - protein, 13 aa, Artificial Sequence
  Description of Artificial Sequence: Synthetic peptide
AKENYRGTGYLES

SEQ ID NO: 1949 - protein, 107 aa, Artificial Sequence
  Description of Artificial Sequence: Synthetic polypeptide
DIQMTQSPSTLAASVGDTVTITCRASYDVKKWVAWYQQKPGKVPKLLIYKASTLEVGVPLRFSGSGSGTEFTLTINGLQPDDFATYYCQHFHSYPYSFGQGTKLDIK

SEQ ID NO: 1950 - protein, 9 aa, Artificial Sequence
  Description of Artificial Sequence: Synthetic peptide
QHFHSYPYS

SEQ ID NO: 1951 - protein, 131 aa, Artificial Sequence
  Description of Artificial Sequence: Synthetic polypeptide
  MOD_RES (67)..(67): Any amino acid
QVQLQESGPGLVKPSGTLSLTCAVSGGSISSSNWWSWVRQPPGKGLEWIGEIYHSGSTNYNPSLKSXVSMSVDKSKNQFSLKLTSVTAADTAVYYCARDYIERVFARREQGLFHYSYMDVWGRGTTVTVSS

SEQ ID NO: 1952 - protein, 24 aa, Artificial Sequence
  Description of Artificial Sequence: Synthetic peptide
ARDYIERVFARREQGLFHYSYMDV

SEQ ID NO: 1953 - protein, 107 aa, Artificial Sequence
  Description of Artificial Sequence: Synthetic polypeptide
DIQMTQSPSSLSAFVGDRVTITCRASQSISNFLNWYQHKPGEAPKVLIFGATNLQSGVPSRFRGSGSGTDFILTISSLQPEDFAVYYCQHNYINPRTFGQGTKVQIK

SEQ ID NO: 1954 - protein, 9 aa, Artificial Sequence
  Description of Artificial Sequence: Synthetic peptide
QHNYINPRT

SEQ ID NO: 1955 - protein, 123 aa, Artificial Sequence
  Description of Artificial Sequence: Synthetic polypeptide
EVQLVESGGGLVKPGGSLRLSCEVSGFTFTNAWMSWVRQAPGKGLEWVARIKNKFDGGTTDYAAPVKGRFTISRDDSKNTLYLQMNSLKTEDTAIYYCSIDLLPYKTGQYFPHWGQGTLVAVS

SEQ ID NO: 1956 - protein, 15 aa, Artificial Sequence
  Description of Artificial Sequence: Synthetic peptide
SIDLLPYKTGQYFPH

SEQ ID NO: 1957 - protein, 106 aa, Artificial Sequence
  Description of Artificial Sequence: Synthetic polypeptide
  MOD_RES (50)..(50): Any amino acid
DIQMTQSPSTLSASIGDRVTITCRASESIANWLAWYQQKPGKAPKLMIYXSFNLKSGVPSRFSASGSGTEFTLTIRSLQPDDSGTYYCQHYHSYPYTFGPGPNLEI

SEQ ID NO: 1958 - protein, 9 aa, Artificial Sequence
  Description of Artificial Sequence: Synthetic peptide
QHYHSYPYT

SEQ ID NO: 1959 - protein, 125 aa, Artificial Sequence; identical to SEQ ID NO: 203
  Description of Artificial Sequence: Synthetic polypeptide

SEQ ID NO: 1960 - protein, 19 aa, Artificial Sequence
  Description of Artificial Sequence: Synthetic peptide
VRRPRRYCSGDTCRGAFDI

SEQ ID NO: 1961 - protein, 107 aa, Artificial Sequence; identical to SEQ ID NO: 204
  Description of Artificial Sequence: Synthetic polypeptide

SEQ ID NO: 1962 - protein, 9 aa, Artificial Sequence
  Description of Artificial Sequence: Synthetic peptide
QKYKIDPFT

SEQ ID NO: 1963 - protein, 125 aa, Artificial Sequence; identical to SEQ ID NO: 203
  Description of Artificial Sequence: Synthetic polypeptide

SEQ ID NO: 1964 - protein, 19 aa, Artificial Sequence
  Description of Artificial Sequence: Synthetic peptide
VRRPRRYCSGDTCRGAFDI

SEQ ID NO: 1965 - protein, 107 aa, Artificial Sequence; identical to SEQ ID NO: 204
  Description of Artificial Sequence: Synthetic polypeptide

SEQ ID NO: 1966 - protein, 9 aa, Artificial Sequence
  Description of Artificial Sequence: Synthetic peptide
QKYKIDPFT

SEQ ID NO: 1967 - protein, 125 aa, Artificial Sequence; identical to SEQ ID NO: 203
  Description of Artificial Sequence: Synthetic polypeptide

SEQ ID NO: 1968 - protein, 19 aa, Artificial Sequence
  Description of Artificial Sequence: Synthetic peptide
VRRPRRYCSGDTCRGAFDI

SEQ ID NO: 1969 - protein, 107 aa, Artificial Sequence; identical to SEQ ID NO: 204
  Description of Artificial Sequence: Synthetic polypeptide

SEQ ID NO: 1970 - protein, 9 aa, Artificial Sequence
  Description of Artificial Sequence: Synthetic peptide
QKYKIDPFT

SEQ ID NO: 1971 - protein, 127 aa, Artificial Sequence
  Description of Artificial Sequence: Synthetic polypeptide
EVQLVESGGGLVKPGGSLRLSCAASGFTFNTYTMNWVRQAPGKGLEWVSSIGSSGSHIYYADSLRGRFTMSRDNAKNSLYLQMNSLRAEDTAVYYCARVGPPGWLQSDYDYYGMDVWGQGTTVIVSS

SEQ ID NO: 1972 - protein, 20 aa, Artificial Sequence
  Description of Artificial Sequence: Synthetic peptide
ARVGPPGWLQSDYDYYGMDV

SEQ ID NO: 1973 - protein, 104 aa, Artificial Sequence
  Description of Artificial Sequence: Synthetic polypeptide
EIVLTQSPGTLSLSPGERATLSCRASQSISSSFLAWYQQKPGQAPRLLIYGAYSRAIGIPDRFSGSGSGTDFTLTISRLEPEDFAVYYCQQFSAFGGGTKVEIK

SEQ ID NO: 1974 - protein, 5 aa, Artificial Sequence
  Description of Artificial Sequence: Synthetic peptide
QQFSA

SEQ ID NO: 1975 - protein, 117 aa, Artificial Sequence
  Description of Artificial Sequence: Synthetic polypeptide
EVQLVESGGGLVQPGGSLRLSCTASGITVSSNYMGWVRQAPGKGLEWVSIVYPGGSTFYADSVKGRFTISRDNSKNMLSLQMSRLRAEDTAVYYCARDLGDSRLDYWGQGTLVTVSS

SEQ ID NO: 1976 - protein, 11 aa, Artificial Sequence
  Description of Artificial Sequence: Synthetic peptide
ARDLGDSRLDY

SEQ ID NO: 1977 - protein, 109 aa, Artificial Sequence
  Description of Artificial Sequence: Synthetic polypeptide
DIQLTQSPSFLSASVGDRVTITCRASQGISNYLAWYQQKPGKAPKLLIYAASTLQSGVPSRFSGSGSGTEFTLAISSLQPEDFATYYCQQLNNNPPGYTFGQGTKLEIK

SEQ ID NO: 1978 - protein, 11 aa, Artificial Sequence
  Description of Artificial Sequence: Synthetic peptide
QQLNNNPPGYT

SEQ ID NO: 1979 - protein, 124 aa, Artificial Sequence
  Description of Artificial Sequence: Synthetic polypeptide
QVQLQESGPGLVKPSQTLSLTCTVSGGSISSSNYYWSWIRQPAGKGLEWIGRIFSSGSTNYNPSLKSRVTISVDTSKKQFSLKLSSVTAADTAVYYCARVDSSGWYTGDTFDIWGQGTMVTVSS

SEQ ID NO: 1980 - protein, 16 aa, Artificial Sequence
  Description of Artificial Sequence: Synthetic peptide
ARVDSSGWYTGDTFDI

SEQ ID NO: 1981 - protein, 108 aa, Artificial Sequence
  Description of Artificial Sequence: Synthetic polypeptide
DIQMTQSPSSLSASVGDRVTITCRASQSINSYLNWYQHKPGKAPKLLIYAAFSLQSGVPSRFSGGGSGTDFTLTISSLQPEDFATYYCQQSFPTPPYTFGQGTKLEIK

SEQ ID NO: 1982 - protein, 10 aa, Artificial Sequence
  Description of Artificial Sequence: Synthetic peptide
QQSFPTPPYT

SEQ ID NO: 1983 - protein, 123 aa, Artificial Sequence; identical to SEQ ID NO: 179
  Description of Artificial Sequence: Synthetic polypeptide

SEQ ID NO: 1984 - protein, 15 aa, Artificial Sequence
  Description of Artificial Sequence: Synthetic peptide
ARRSITLAGRDCLDF

SEQ ID NO: 1985 - protein, 106 aa, Artificial Sequence
  Description of Artificial Sequence: Synthetic polypeptide
DIQMTQSPSSLSASVGDRLTITCRASQSITTSLNWYQQKPGKAPKLLIYAASSLQSGVPSRFSGSGSGTDFTLAISSLQPEDFATYYCQQSYIPLLTFGGGTKVEI

SEQ ID NO: 1986 - protein, 9 aa, Artificial Sequence
  Description of Artificial Sequence: Synthetic peptide
QQSYIPLLT

SEQ ID NO: 1987 - protein, 119 aa, Artificial Sequence; identical to SEQ ID NO: 185
  Description of Artificial Sequence: Synthetic polypeptide

SEQ ID NO: 1988 - protein, 13 aa, Artificial Sequence
  Description of Artificial Sequence: Synthetic peptide
ARPGITATTGFDF

SEQ ID NO: 1989 - protein, 107 aa, Artificial Sequence
  Description of Artificial Sequence: Synthetic polypeptide
DIQMTQSPSSLSASVGDRVTITCRASQSISTYLNWYHQKPGKAPKVLIYAASSLQGGVPSTFSGSGSGTDFTLTISSLQPDDFGTYYCQQSYNMPLTFGGGTKVEIK

SEQ ID NO: 1990 - protein, 9 aa, Artificial Sequence
  Description of Artificial Sequence: Synthetic peptide
QQSYNMPLT

SEQ ID NO: 1991 - protein, 124 aa, Artificial Sequence
  Description of Artificial Sequence: Synthetic polypeptide
EVQLVESGGDLTQPGGSLRLSCAASGFTFSNYDMHWVRQATGKGLEWVSGIGTSGDTYYADSVKGRFTISRENAKNSLFLQMNHLRAGDTATYYCARTEYAWGSYRSYWYFDLWGRGTQVTVSS

SEQ ID NO: 1992 - protein, 18 aa, Artificial Sequence
  Description of Artificial Sequence: Synthetic peptide
ARTEYAWGSYRSYWYFDL

SEQ ID NO: 1993 - protein, 108 aa, Artificial Sequence
  Description of Artificial Sequence: Synthetic polypeptide
DIQMTQSPSSLSASVGDRVTITCRTSQTISTYLNWYQQKPGKAPKVLIFAASSLQSGVPSRFSGSGSGTDFTLTISSLQPEDFATYFCQQSYSAPPWTFGPGTKVEIK

SEQ ID NO: 1994 - protein, 10 aa, Artificial Sequence
  Description of Artificial Sequence: Synthetic peptide
QQSYSAPPWT

SEQ ID NO: 1995 - protein, 118 aa, Artificial Sequence
  Description of Artificial Sequence: Synthetic polypeptide
EVQLVESGGGLVQPGGSLRLSCAASGFTFSSYDMHWVRQATGKGLEWVSAIGTAGDTYYPDSVKGRFTISRENAKNSLYLQMNSLRAGDTAVYYCVRDPTKSWYFDLWGRGTLVTVAS

SEQ ID NO: 1996 - protein, 12 aa, Artificial Sequence
  Description of Artificial Sequence: Synthetic peptide
VRDPTKSWYFDL

SEQ ID NO: 1997 - protein, 108 aa, Artificial Sequence
  Description of Artificial Sequence: Synthetic polypeptide
DIQMTQSPSSLSASVGDRVTITCRASQSISSYLNWYQQKPGKAPQLLIYAASSLQSGVPSRFSGSGSGTDFTLTVSSLQPEDFATYYCQQSYSTPPITFGQGTRLEIK

SEQ ID NO: 1998 - protein, 10 aa, Artificial Sequence
  Description of Artificial Sequence: Synthetic peptide
QQSYSTPPIT

SEQ ID NO: 1999 - protein, 131 aa, Artificial Sequence; identical to SEQ ID NO: 1871
  Description of Artificial Sequence: Synthetic polypeptide

SEQ ID NO: 2000 - protein, 21 aa, Artificial Sequence
  Description of Artificial Sequence: Synthetic peptide
ARMWVVAGTTDDYYYHYGMDV

SEQ ID NO: 2001 - protein, 107 aa, Artificial Sequence
  Description of Artificial Sequence: Synthetic polypeptide
DIQMTQSPSSVSASVGDRVTITCRASQGISNWLAWYQQKPGKAPKVLLYAASSLRSGVPSRFSGSGSGTDFTLTISSLQPEDFATYYCQQTNTLPLSFGGGTKVEIK

SEQ ID NO: 2002 - protein, 9 aa, Artificial Sequence
  Description of Artificial Sequence: Synthetic peptide
QQTNTLPLS

SEQ ID NO: 2003 - protein, 117 aa, Artificial Sequence
  Description of Artificial Sequence: Synthetic polypeptide
EVQLVESGGGLIQPGGSLRLSCAASEFIVSYNYMSWVRQAPGKGLEWVSTIYSGGSTYYADSVKGRFTISRDNSKNTLHLQMIRLRVEDTAVYYCARDRGGGILDFWGQGTLVTVSS

SEQ ID NO: 2004 - protein, 11 aa, Artificial Sequence
  Description of Artificial Sequence: Synthetic peptide
ARDRGGGILDF

SEQ ID NO: 2005 - protein, 107 aa, Artificial Sequence; identical to SEQ ID NO: 2001
  Description of Artificial Sequence: Synthetic polypeptide

SEQ ID NO: 2006 - protein, 9 aa, Artificial Sequence
  Description of Artificial Sequence: Synthetic peptide
QQTNTLPLS

SEQ ID NO: 2007 - protein, 124 aa, Artificial Sequence
  Description of Artificial Sequence: Synthetic polypeptide
EVQLVESGGGLVQPGGSLRLSCAASGFSFSSYSMNWVRQAPGKGLEWVSYIGGSGSIIYYADSVKGRFTLSRDNAKNSLSLHMHSLRAEDTAVYYCARGSGAARSYYYYGLDVWGQGTTVTVSS

SEQ ID NO: 2008 - protein, 17 aa, Artificial Sequence
  Description of Artificial Sequence: Synthetic peptide
ARGSGAARSYYYYGLDV

SEQ ID NO: 2009 - protein, 107 aa, Artificial Sequence
  Description of Artificial Sequence: Synthetic polypeptide
DIQMTQSPSSLSASVGDRVTITCRASQSINNYLNWYHQKPGKAPKLLIYATSTLQSGVPSRFSGSGSGPDFTLTISSLQPEDFATYYCQQTYSTPPTFGQGTRLEIK

SEQ ID NO: 2010 - protein, 9 aa, Artificial Sequence
  Description of Artificial Sequence: Synthetic peptide
QQTYSTPPT

SEQ ID NO: 2011 - protein, 125 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTSYSPSLKSRVTISVDTSKNQFSLKLTSVTAADTAVYYCARQRDTDMAMLFQYTGLDVWGQGTTVTVSS

SEQ ID NO: 2012 - protein, 19 aa, Artificial Sequence
  Description of Artificial Sequence: Synthetic peptide
ARQRDTDMAMLFQYTGLDV

SEQ ID NO: 2013 - protein, 107 aa, Artificial Sequence
  Description of Artificial Sequence: Synthetic polypeptide
DIQMTQSPSSLSASVGDRVTVTCRASQSITTYLNWYQQKPRKAPKLLIYAVSNLQGGVPSRFSGSGSGTFFNFTIDGLQPEDIATYYCQQTYSTPRTFGQGTKVEIE

SEQ ID NO: 2014 - protein, 9 aa, Artificial Sequence
  Description of Artificial Sequence: Synthetic peptide
QQTYSTPRT

SEQ ID NO: 2015 - protein, 124 aa, Artificial Sequence
  Description of Artificial Sequence: Synthetic polypeptide
QVQLVESGGGVVQPGRSLRLSCAASGFTFRIYAMHWVRQAPGKGLEWVAIIWNDGSKQYYADSMKGRFTISRDNSKNTLYLQMNSLRDEDTALYYCAREGVALAGNGVDGFDIWGQGTMVTVSS

SEQ ID NO: 2016 - protein, 17 aa, Artificial Sequence
  Description of Artificial Sequence: Synthetic peptide
AREGVALAGNGVDGFDI

SEQ ID NO: 2017 - protein, 107 aa, Artificial Sequence
  Description of Artificial Sequence: Synthetic polypeptide
DIQMTQSPSSLSASVGDRVTITCRASQTISTFLNWYRQIPGKAPKLLIYAASSLQSGVPSRFSGSGSGTDFTLTISSLQPEDFATYYCQQTYSTPYTFGRGTKLEIK

SEQ ID NO: 2018 - protein, 9 aa, Artificial Sequence
  Description of Artificial Sequence: Synthetic peptide
QQTYSTPYT

SEQ ID NO: 2019 - protein, 119 aa, Artificial Sequence
  Description of Artificial Sequence: Synthetic polypeptide
EVQLVESGGGLVQPGGSLRLSCAASGFTVSNNYMTWVRQAPGKGLGWVAVMFIGSTYYADSVKGRFTMSRDNSKNTLYLQMNSLRAEDTALYYCARGRPFRGRGAFDIWGQGTMVTVSS

SEQ ID NO: 2020 - protein, 14 aa, Artificial Sequence
  Description of Artificial Sequence: Synthetic peptide
ARGRPFRGRGAFDI

SEQ ID NO: 2021 - protein, 108 aa, Artificial Sequence
  Description of Artificial Sequence: Synthetic polypeptide
DIQMTQSPSSLSASVGDRVTITCQASQDINNYLNWYQQKPGKAPKLLIYDASNLETGVPSRFSGSGSGTDFTFTISSLQPEDIATYYCQQYDNLPPLTFGGGTKVEIK

SEQ ID NO: 2022 - protein, 10 aa, Artificial Sequence
  Description of Artificial Sequence: Synthetic peptide
QQYDNLPPLT

SEQ ID NO: 2023 - protein, 128 aa, Artificial Sequence
  Description of Artificial Sequence: Synthetic polypeptide
QVQLQQSGPGLVKPSQTLSLTCAISGDSVSSSGAAWNWIRQSPSRGLEWLGRTYYKSKWYNDYAVSVKSRITINPDTSKNQFSLQLNSVTPEDTAVYYCARMWVVAGTTDDYYYHYGMDVWGQGTTVT

SEQ ID NO: 2024 - protein, 21 aa, Artificial Sequence
  Description of Artificial Sequence: Synthetic peptide
ARMWVVAGTTDDYYYHYGMDV

SEQ ID NO: 2025 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPYTFGQGTKLEIK

SEQ ID NO: 2026 - protein, 9 aa, Artificial Sequence
  Description of Artificial Sequence: Synthetic peptide
QQYDNLPYT

SEQ ID NO: 2027 - protein, 123 aa, Artificial Sequence
  Description of Artificial Sequence: Synthetic polypeptide
EVQLVESGGGLVQPGRSLRLSCAASGFTFDDYALHWVRQAPGKGLEWVSGISWNSASIHYADSVKGRFTISRDNAKNSLYLQMNRLRAEDTALYYCAKVRLYSTYLRGPFDIWGQGTMVTVSS

SEQ ID NO: 2028 - protein, 16 aa, Artificial Sequence
  Description of Artificial Sequence: Synthetic peptide
AKVRLYSTYLRGPFDI

SEQ ID NO: 2029 - protein, 108 aa, Artificial Sequence
  Description of Artificial Sequence: Synthetic polypeptide
DIQMTQSPSSLSASVGDRVTITCQASQDIRQNLNWYQHKPGKAPKLLIYGASTLETGVPSRFSGSGSGTDFTFTISSLQPEDIAAYYCQQYDNLSPLTFGGGTKVEIK

SEQ ID NO: 2030 - protein, 10 aa, Artificial Sequence
  Description of Artificial Sequence: Synthetic peptide
QQYDNLSPLT

SEQ ID NO: 2031 - protein, 116 aa, Artificial Sequence; identical to SEQ ID NO: 207
  Description of Artificial Sequence: Synthetic polypeptide

SEQ ID NO: 2032 - protein, 11 aa, Artificial Sequence
  Description of Artificial Sequence: Synthetic peptide
ARDRGGGILDY

SEQ ID NO: 2033 - protein, 108 aa, Artificial Sequence
  Description of Artificial Sequence: Synthetic polypeptide
DIQMTQSPSSLSASVGDRVTITCQASQDINIFLNWYQQKPGKAPKLLIYDASSLETGVPSRFSGSGSGTDFTFTISSLQPEDFATYYCQQYGNLPKYTFGQGTNLEIK

SEQ ID NO: 2034 - protein, 10 aa, Artificial Sequence
  Description of Artificial Sequence: Synthetic peptide
QQYGNLPKYT

SEQ ID NO: 2035 - protein, 117 aa, Artificial Sequence; identical to SEQ ID NO: 2003
  Description of Artificial Sequence: Synthetic polypeptide

SEQ ID NO: 2036 - protein, 11 aa, Artificial Sequence
  Description of Artificial Sequence: Synthetic peptide
ARDRGGGILDF

SEQ ID NO: 2037 - protein, 107 aa, Artificial Sequence
  Description of Artificial Sequence: Synthetic polypeptide
DIQMTQSPSSLSASVGDRVTITCQASQDINKYLNWYQQKPGKAPKLLIYDASNLEAGVPSRFSGRGSGTDFTFTISSLQPEDIATYYCQQYGNLPKYTFGQGTKLEI

SEQ ID NO: 2038 - protein, 10 aa, Artificial Sequence
  Description of Artificial Sequence: Synthetic peptide
QQYGNLPKYT

SEQ ID NO: 2039 - protein, 122 aa, Artificial Sequence
  Description of Artificial Sequence: Synthetic polypeptide
QVQLQESGPGLMKPSQTLSLTCSVSGDSIRSGNNHWSWIRQPAGKGLEWIGRVYMSGDTHYNPSLKSRVTISVDTSKNHFSLKLSSVTAADTAVYYCTRGLRFLDYPVLDVWGTGTTVTVSS

SEQ ID NO: 2040 - protein, 14 aa, Artificial Sequence
  Description of Artificial Sequence: Synthetic peptide
TRGLRFLDYPVLDV

SEQ ID NO: 2041 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLYMYTFGQGTKLEIK

SEQ ID NO: 2042 - protein, 11 aa, Artificial Sequence
  Description of Artificial Sequence: Synthetic peptide
QQYGSSLYMYT

SEQ ID NO: 2043 - protein, 122 aa, Artificial Sequence; identical to SEQ ID NO: 197
  Description of Artificial Sequence: Synthetic polypeptide

SEQ ID NO: 2044 - protein, 15 aa, Artificial Sequence
  Description of Artificial Sequence: Synthetic peptide
ARHYDILTSLSWFDP

SEQ ID NO: 2045 - protein, 108 aa, Artificial Sequence
  Description of Artificial Sequence: Synthetic polypeptide
EIVLTQSPGTLSLSPGERATLSCRASQSISSSYLAWYQQKPGQAPRLLIYGASIRATGIPDRFSGRGSGTDFTLTISRLEPEDFAVYYCQQYGSSLYTFGQGTKLEIK

SEQ ID NO: 2046 - protein, 9 aa, Artificial Sequence
  Description of Artificial Sequence: Synthetic peptide
QQYGSSLYT

SEQ ID NO: 2047 - protein, 126 aa, Artificial Sequence
  Description of Artificial Sequence: Synthetic polypeptide
QVQLVESGGRLVKPGGSLRLSCVASGFTLSDYYMSWIRQAPGRGLEWLSYSSDGDETIYYADSVKGRFTISTDNAKNSLYLQMNSLTAEDTAVYFCARDRGTTSSYYSYYYGMDVWGQGTSVTVSS

SEQ ID NO: 2048 - protein, 19 aa, Artificial Sequence
  Description of Artificial Sequence: Synthetic peptide
ARDRGTTSSYYSYYYGMDV

SEQ ID NO: 2049 - protein, 108 aa, Artificial Sequence
  Description of Artificial Sequence: Synthetic polypeptide
EIVLTQSPGTLSLSPGERATLSCRASQSVDSSDLAWYQQKPGQAPRLLIYGASSRATGVPDRFSGSGSGTDFTLTISRLEPEDFVVYYCQQYGSSPGTFGGGTRVEIK

SEQ ID NO: 2050 - protein, 9 aa, Artificial Sequence
  Description of Artificial Sequence: Synthetic peptide
QQYGSSPGT

SEQ ID NO: 2051 - protein, 121 aa, Artificial Sequence; identical to SEQ ID NO: 195
  Description of Artificial Sequence: Synthetic polypeptide

SEQ ID NO: 2052 - protein, 15 aa, Artificial Sequence
  Description of Artificial Sequence: Synthetic peptide
ARHYDILTALSWFDP

SEQ ID NO: 2053 - protein, 111 aa, Artificial Sequence; identical to SEQ ID NO: 196
  Description of Artificial Sequence: Synthetic polypeptide

SEQ ID NO: 2054 - protein, 12 aa, Artificial Sequence
  Description of Artificial Sequence: Synthetic peptide
GTWDSSLSAYWV

SEQ ID NO: 2055 - protein, 121 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARLLSTEWLFNWFDPWGQGTLVTVSS

SEQ ID NO: 2056 - protein, 15 aa, Artificial Sequence
  Description of Artificial Sequence: Synthetic peptide
ARLLSTEWLFNWFDP

SEQ ID NO: 2057 - protein, 107 aa, Artificial Sequence
  Description of Artificial Sequence: Synthetic polypeptide
SYVLTQPPSVSVSPGQTASITCSGDKLGDKYACWYQQKPGQSPVLVIYQDSKRPSGIPERFSGSNSGNTATLTISGTQAMDEADYYCQAWDSSTAYVFGTGTKVTVL

SEQ ID NO: 2058 - protein, 10 aa, Artificial Sequence
  Description of Artificial Sequence: Synthetic peptide
QAWDSSTAYV

SEQ ID NO: 2059 - protein, 121 aa, Artificial Sequence; identical to SEQ ID NO: 201
  Description of Artificial Sequence: Synthetic polypeptide

SEQ ID NO: 2060 - protein, 14 aa, Artificial Sequence
  Description of Artificial Sequence: Synthetic peptide
ARQPESTIWYYFDY

SEQ ID NO: 2061 - protein, 108 aa, Artificial Sequence; identical to SEQ ID NO: 202
  Description of Artificial Sequence: Synthetic polypeptide

SEQ ID NO: 2062 - protein, 11 aa, Artificial Sequence
  Description of Artificial Sequence: Synthetic peptide
QSADSSGSYVV

SEQ ID NO: 2063 - protein, 121 aa, Artificial Sequence; identical to SEQ ID NO: 201
  Description of Artificial Sequence: Synthetic polypeptide

SEQ ID NO: 2064 - protein, 14 aa, Artificial Sequence
  Description of Artificial Sequence: Synthetic peptide
ARQPESTIWYYFDY

SEQ ID NO: 2065 - protein, 108 aa, Artificial Sequence
  Description of Artificial Sequence: Synthetic polypeptide
SYVLTQPPSVSVSPGQTARVTCSGHALPDQYTYWYQQRPGRAPVLVIYVNNQRPSGIPDRFSATTSGTTVTLTISGVQAEDEADYYCQSADSSGSYVVFGGGTKLTVL

SEQ ID NO: 2066 - protein, 11 aa, Artificial Sequence
  Description of Artificial Sequence: Synthetic peptide
QSADSSGSYVV

SEQ ID NO: 2067 - protein, 121 aa, Artificial Sequence; identical to SEQ ID NO: 201
  Description of Artificial Sequence: Synthetic polypeptide

SEQ ID NO: 2068 - protein, 14 aa, Artificial Sequence
  Description of Artificial Sequence: Synthetic peptide
ARQPESTIWYYFDY

SEQ ID NO: 2069 - protein, 108 aa, Artificial Sequence; identical to SEQ ID NO: 202
  Description of Artificial Sequence: Synthetic polypeptide

SEQ ID NO: 2070 - protein, 11 aa, Artificial Sequence
  Description of Artificial Sequence: Synthetic peptide
QSADSSGSYVV

SEQ ID NO: 2071 - protein, 124 aa, Artificial Sequence
  Description of Artificial Sequence: Synthetic polypeptide
QVQLVESGGGVVQPGRSLRLSCAASGFTFNRIAMYWVRQAPGKGLEWVAVISFDGSYEYYAESVKGRFAISRDNSKNTLYLQMNSLRAEDTAVYYCAKSPMGYCTNGVCYPDSWGQGTLVTVSS

SEQ ID NO: 2072 - protein, 17 aa, Artificial Sequence
  Description of Artificial Sequence: Synthetic peptide
AKSPMGYCTNGVCYPDS

SEQ ID NO: 2073 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDTQRPSGVPDRFSGSIDSSSNSASLTISGLKTEDEADYYCQSYDINSRWVFGGGTKLTVL

SEQ ID NO: 2074 - protein, 10 aa, Artificial Sequence
  Description of Artificial Sequence: Synthetic peptide
QSYDINSRWV

SEQ ID NO: 2075 - protein, 124 aa, Artificial Sequence; identical to SEQ ID NO: 2071
  Description of Artificial Sequence: Synthetic polypeptide

SEQ ID NO: 2076 - protein, 17 aa, Artificial Sequence
  Description of Artificial Sequence: Synthetic peptide
AKSPMGYCTNGVCYPDS

SEQ ID NO: 2077 - protein, 111 aa, Artificial Sequence; identical to SEQ ID NO: 2073
  Description of Artificial Sequence: Synthetic polypeptide

SEQ ID NO: 2078 - protein, 10 aa, Artificial Sequence
  Description of Artificial Sequence: Synthetic peptide
QSYDINSRWV

SEQ ID NO: 2079 - protein, 119 aa, Artificial Sequence; identical to SEQ ID NO: 311
  Description of Artificial Sequence: Synthetic polypeptide

SEQ ID NO: 2080 - protein, 12 aa, Artificial Sequence
  Description of Artificial Sequence: Synthetic peptide
ARGVAVDWYFDL

SEQ ID NO: 2081 - protein, 112 aa, Artificial Sequence; identical to SEQ ID NO: 312
  Description of Artificial Sequence: Synthetic polypeptide

SEQ ID NO: 2082 - protein, 12 aa, Artificial Sequence
  Description of Artificial Sequence: Synthetic peptide
QSYDSSLSALYV

SEQ ID NO: 2083 - protein, 119 aa, Artificial Sequence; identical to SEQ ID NO: 311
  Description of Artificial Sequence: Synthetic polypeptide

SEQ ID NO: 2084 - protein, 12 aa, Artificial Sequence
  Description of Artificial Sequence: Synthetic peptide
ARGVAVDWYFDL

SEQ ID NO: 2085 - protein, 112 aa, Artificial Sequence; identical to SEQ ID NO: 312
  Description of Artificial Sequence: Synthetic polypeptide

SEQ ID NO: 2086 - protein, 12 aa, Artificial Sequence
  Description of Artificial Sequence: Synthetic peptide
QSYDSSLSALYV

SEQ ID NO: 2087 - protein, 119 aa, Artificial Sequence; identical to SEQ ID NO: 311
  Description of Artificial Sequence: Synthetic polypeptide

SEQ ID NO: 2088 - protein, 12 aa, Artificial Sequence
  Description of Artificial Sequence: Synthetic peptide
ARGVAVDWYFDL

SEQ ID NO: 2089 - protein, 112 aa, Artificial Sequence; identical to SEQ ID NO: 312
  Description of Artificial Sequence: Synthetic polypeptide

SEQ ID NO: 2090 - protein, 12 aa, Artificial Sequence
  Description of Artificial Sequence: Synthetic peptide
QSYDSSLSALYV

SEQ ID NO: 2091 - protein, 119 aa, Artificial Sequence; identical to SEQ ID NO: 311
  Description of Artificial Sequence: Synthetic polypeptide

SEQ ID NO: 2092 - protein, 12 aa, Artificial Sequence
  Description of Artificial Sequence: Synthetic peptide
ARGVAVDWYFDL

SEQ ID NO: 2093 - protein, 112 aa, Artificial Sequence; identical to SEQ ID NO: 312
  Description of Artificial Sequence: Synthetic polypeptide

SEQ ID NO: 2094 - protein, 12 aa, Artificial Sequence
  Description of Artificial Sequence: Synthetic peptide
QSYDSSLSALYV

SEQ ID NO: 2095 - protein, 119 aa, Artificial Sequence; identical to SEQ ID NO: 311
  Description of Artificial Sequence: Synthetic polypeptide

SEQ ID NO: 2096 - protein, 12 aa, Artificial Sequence
  Description of Artificial Sequence: Synthetic peptide
ARGVAVDWYFDL

SEQ ID NO: 2097 - protein, 112 aa, Artificial Sequence; identical to SEQ ID NO: 312
  Description of Artificial Sequence: Synthetic polypeptide

SEQ ID NO: 2098 - protein, 12 aa, Artificial Sequence
  Description of Artificial Sequence: Synthetic peptide
QSYDSSLSALYV

SEQ ID NO: 2099 - protein, 119 aa, Artificial Sequence
  Description of Artificial Sequence: Synthetic polypeptide
EVQLVQSGAEVKKPGESLKISCKGSGYSFTSYWTGWVRQMPGKGLEWMGIIYPGDSDTRYRPAFQGQVTISADKSISTAYLQWSSLKASDTAMYYCARGVAVDWYFDLWGRGTLVTVSS

SEQ ID NO: 2100 - protein, 12 aa, Artificial Sequence
  Description of Artificial Sequence: Synthetic peptide
ARGVAVDWYFDL

SEQ ID NO: 2101 - protein, 112 aa, Artificial Sequence; identical to SEQ ID NO: 312
  Description of Artificial Sequence: Synthetic polypeptide

SEQ ID NO: 2102 - protein, 12 aa, Artificial Sequence
  Description of Artificial Sequence: Synthetic peptide
QSYDSSLSALYV

SEQ ID NO: 2103 - protein, 119 aa, Artificial Sequence
  Description of Artificial Sequence: Synthetic polypeptide
EVQLVQSGAEVKKPGESLKISCKGSGYSFTTYWIGWVRQMPGKGLEWMGIIYPADSDTRYSPSFQGQVTISADKSISTAYLQWSSLKASDTAMYYCARGVAVDWYFDLWGRGTLVTVSS

SEQ ID NO: 2104 - protein, 12 aa, Artificial Sequence
  Description of Artificial Sequence: Synthetic peptide
ARGVAVDWYFDL

SEQ ID NO: 2105 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGYTNRPSGVPDRFSGSKSGTSASLAITGLQAEDEADYYCQSYDSSLSALYVFGTGTKVTVL

SEQ ID NO: 2106 - protein, 12 aa, Artificial Sequence
  Description of Artificial Sequence: Synthetic peptide
QSYDSSLSALYV

SEQ ID NO: 2107 - protein, 119 aa, Artificial Sequence; identical to SEQ ID NO: 311
  Description of Artificial Sequence: Synthetic polypeptide

SEQ ID NO: 2108 - protein, 12 aa, Artificial Sequence
  Description of Artificial Sequence: Synthetic peptide
ARGVAVDWYFDL

SEQ ID NO: 2109 - protein, 112 aa, Artificial Sequence
  Description of Artificial Sequence: Synthetic polypeptide
QSVLTQPPSVSGAPGQRVTISCTGSSSNIGAGSDVHWYQQLPGTAPKLLIYGNSNRPSGVPDRFSGSKSGTSASLAITGLQAEDEADYYCQSYDSSLSALYVFGTGTKVTVL

SEQ ID NO: 2110 - protein, 12 aa, Artificial Sequence
  Description of Artificial Sequence: Synthetic peptide
QSYDSSLSALYV

SEQ ID NO: 2111 - protein, 127 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAGFGVVITYGSGTDPLFDYWGQGTLVTVSS

SEQ ID NO: 2112 - protein, 21 aa, Artificial Sequence
  Description of Artificial Sequence: Synthetic peptide
ARAGFGVVITYGSGTDPLFDY

SEQ ID NO: 2113 - protein, 112 aa, Artificial Sequence
  Description of Artificial Sequence: Synthetic polypeptide
QSVLTQPPSVSGAPGQRVTISCTGSNSNIGAGYDVHWYQQLPGTAPKLLIYGNSNRPSGVPDRFSGSKSGTSASLAITGLQAEDEADYYCQSYDSSLSGSRVFGGGTKLTVL

SEQ ID NO: 2114 - protein, 12 aa, Artificial Sequence
  Description of Artificial Sequence: Synthetic peptide
QSYDSSLSGSRV

SEQ ID NO: 2115 - protein, 127 aa, Artificial Sequence; identical to SEQ ID NO: 2111
  Description of Artificial Sequence: Synthetic polypeptide

SEQ ID NO: 2116 - protein, 21 aa, Artificial Sequence
  Description of Artificial Sequence: Synthetic peptide
ARAGFGVVITYGSGTDPLFDY

SEQ ID NO: 2117 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSRVFGGGTKLTVL

SEQ ID NO: 2118 - protein, 12 aa, Artificial Sequence
  Description of Artificial Sequence: Synthetic peptide
QSYDSSLSGSRV

SEQ ID NO: 2119 - protein, 124 aa, Artificial Sequence; identical to SEQ ID NO: 191
  Description of Artificial Sequence: Synthetic polypeptide

SEQ ID NO: 2120 - protein, 17 aa, Artificial Sequence
  Description of Artificial Sequence: Synthetic peptide
ARDSGYSGYGSTYYMDV

SEQ ID NO: 2121 - protein, 111 aa, Artificial Sequence; identical to SEQ ID NO: 192
  Description of Artificial Sequence: Synthetic polypeptide

SEQ ID NO: 2122 - protein, 11 aa, Artificial Sequence
  Description of Artificial Sequence: Synthetic peptide
QSYDSSLSGSV

SEQ ID NO: 2123 - protein, 119 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISSAYLQWSSLKASDTAMYYCARGVAVDWYFDLWGRGTLVTVSS

SEQ ID NO: 2124 - protein, 12 aa, Artificial Sequence
  Description of Artificial Sequence: Synthetic peptide
ARGVAVDWYFDL

SEQ ID NO: 2125 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVLYVFGTGTKVTVL

SEQ ID NO: 2126 - protein, 12 aa, Artificial Sequence
  Description of Artificial Sequence: Synthetic peptide
QSYDSSLSVLYV

SEQ ID NO: 2127 - protein, 121 aa, Artificial Sequence; identical to SEQ ID NO: 1203
  Description of Artificial Sequence: Synthetic polypeptide

SEQ ID NO: 2128 - protein, 14 aa, Artificial Sequence
  Description of Artificial Sequence: Synthetic peptide
AKDTGSMIVELLGY

SEQ ID NO: 2129 - protein, 109 aa, Artificial Sequence
  Description of Artificial Sequence: Synthetic polypeptide
QSVLTQPPSVSGAPGQRVTISCTGSSSNIGAGSDVHWYQKLPGTAPKVFIYGYNNRPSGVPDRFSGSKSGTSASLAITGLQAEDEADYYCQSYDTSLRVVFGGGTKLTV

SEQ ID NO: 2130 - protein, 10 aa, Artificial Sequence
  Description of Artificial Sequence: Synthetic peptide
QSYDTSLRVV

SEQ ID NO: 2131 - protein, 121 aa, Artificial Sequence
  Description of Artificial Sequence: Synthetic polypeptide
EVQLVESGGGLVQPGGSLRLSCAASGFTFSSYAMHWVRQAPGKGLEYVSGISSNGGSPYYANSVKGRFTISRDNSKNTLYLQMGSLRAEDMAVYYCARGPIAAAGSYFDYWGQGTLVTVSS

SEQ ID NO: 2132 - protein, 14 aa, Artificial Sequence
  Description of Artificial Sequence: Synthetic peptide
ARGPIAAAGSYFDY

SEQ ID NO: 2133 - protein, 109 aa, Artificial Sequence
  Description of Artificial Sequence: Synthetic polypeptide
SYVLTQPPSVSVAPGQTARITCGGNNIGSKNVHWYQQKPGQAPVLVVYDDSDRPSGIPERFSGSNSGNTATLTISRVEAGDEADYYCQVWDSSSDPHWVFGGGTKLTVL

SEQ ID NO: 2134 - protein, 12 aa, Artificial Sequence
  Description of Artificial Sequence: Synthetic peptide
QVWDSSSDPHWV

SEQ ID NO: 2135 - protein, 127 aa, Artificial Sequence
  Description of Artificial Sequence: Synthetic polypeptide
EVQLVESGGGLVQPGGSLRLSCAASGFTFSSYAMHWVRQAPGKGLEYVSVISSNGGSTYYANSVKGRFTISRDNSKNTLYLQMGSLRAEDMAVYYCAREGPFLPSLYSSSRDAFDIWGQGTMVTVSS

SEQ ID NO: 2136 - protein, 20 aa, Artificial Sequence
  Description of Artificial Sequence: Synthetic peptide
AREGPFLPSLYSSSRDAFDI

SEQ ID NO: 2137 - protein, 108 aa, Artificial Sequence
  Description of Artificial Sequence: Synthetic polypeptide
SYVLTQPPSVSVAPGQTARITCGGNNIGSKSVHWYQQKPGQAPVLVVYDDSDRPSGIPERFSGSNSGDTATLTISRVEAGDEADYYCQVWDSSSDPHYVFGTGTKVTV

SEQ ID NO: 2138 - protein, 12 aa, Artificial Sequence
  Description of Artificial Sequence: Synthetic peptide
QVWDSSSDPHYV

SEQ ID NO: 2139 - protein, 130 aa, Artificial Sequence
  Description of Artificial Sequence: Synthetic polypeptide
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDPHCSSTSCPIFYYYYMDVWGKGTTVTVSS

SEQ ID NO: 2140 - protein, 21 aa, Artificial Sequence
  Description of Artificial Sequence: Synthetic peptide
TTDPHCSSTSCPIFYYYYMDV

SEQ ID NO: 2141 - protein, 108 aa, Artificial Sequence
  Description of Artificial Sequence: Synthetic polypeptide
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDQGVFGGGTKLTVL

SEQ ID NO: 2142 - protein, 11 aa, Artificial Sequence
  Description of Artificial Sequence: Synthetic peptide
QVWDSSSDQGV

SEQ ID NO: 2143 - protein, 130 aa, Artificial Sequence; identical to SEQ ID NO: 2139
  Description of Artificial Sequence: Synthetic polypeptide

SEQ ID NO: 2144 - protein, 21 aa, Artificial Sequence
  Description of Artificial Sequence: Synthetic peptide
TTDPHCSSTSCPIFYYYYMDV

SEQ ID NO: 2145 - protein, 108 aa, Artificial Sequence; identical to SEQ ID NO: 2141
  Description of Artificial Sequence: Synthetic polypeptide

SEQ ID NO: 2146 - protein, 11 aa, Artificial Sequence
  Description of Artificial Sequence: Synthetic peptide
QVWDSSSDQGV

SEQ ID NO: 2147 - protein, 125 aa, Artificial Sequence
  Description of Artificial Sequence: Synthetic polypeptide
QVQLVQSGAEVKKPGASVKVSCKASGYTFSNYYIHWVRQAPGKGLEWMGMINPNGGTTRYPLKFQGRVTMTRDTSTRTVYMELNSLRSEDTALYFCAREIPDILEVVAATGSLDDWGQGSLVTVS

SEQ ID NO: 2148 - protein, 19 aa, Artificial Sequence
  Description of Artificial Sequence: Synthetic peptide
AREIPDILEVVAATGSLDD

SEQ ID NO: 2149 - protein, 109 aa, Artificial Sequence
  Description of Artificial Sequence: Synthetic polypeptide
QSVLTQPPSASGSPGQSVTISCTGTRSDVGGYNYVSWYQQHPGKAPKLIIYEVTKRPSGVPDRFSGSKSGDTASLTVSGLQADDEADYFCSSYAGITNLVFGGGTKLTV

SEQ ID NO: 2150 - protein, 10 aa, Artificial Sequence
  Description of Artificial Sequence: Synthetic peptide
SSYAGITNLV

SEQ ID NO: 2151 - protein, 119 aa, Artificial Sequence
  Description of Artificial Sequence: Synthetic polypeptide
EVQLVQSGAEVKKPGESLKISCKGSGYSFTSYWIGWVRQMPGKGLEWVGIIYPGDSDTRYSPSFQGQVTISADKSISTAYLQWSSLKASDTAMYYCARGIAVDWYFDLWGRGTLVTVSS

SEQ ID NO: 2152 - protein, 12 aa, Artificial Sequence
  Description of Artificial Sequence: Synthetic peptide
ARGIAVDWYFDL

SEQ ID NO: 2153 - protein, 111 aa, Artificial Sequence
  Description of Artificial Sequence: Synthetic polypeptide
QSVLTQPASVSGSPGQSITISCTGTSSDIGVYNYISWSQQHPGKAPKVMIYDVTNRPSGVSNRFSGSKSGNTASLTISGLQAEDEADYYCSSYRGSSTPYVFGTGTKVTVL

SEQ ID NO: 2154 - protein, 11 aa, Artificial Sequence
  Description of Artificial Sequence: Synthetic peptide
SSYRGSSTPYV

SEQ ID NO: 2155 - protein, 130 aa, Artificial Sequence
  Description of Artificial Sequence: Synthetic polypeptide
QVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCAREYLERYFDGGQRWISYYYMDVWGKGTAVTVSS

SEQ ID NO: 2156 - protein, 23 aa, Artificial Sequence
  Description of Artificial Sequence: Synthetic peptide
AREYLERYFDGGQRWISYYYMDV

SEQ ID NO: 2157 - protein, 111 aa, Artificial Sequence
  Description of Artificial Sequence: Synthetic polypeptide
QSVLTQPASVSGSPGQSITISCTGTSSDVGGYNYVSWYQQHPGKAPKLMIYDVSNRPSGVSNRFSGSKSGNTASLTISGLQAEDEADYYCSSYTPNSTLVVFGGGTKLTVL

SEQ ID NO: 2158 - protein, 11 aa, Artificial Sequence
  Description of Artificial Sequence: Synthetic peptide
SSYTPNSTLVV

SEQ ID NO: 2159 - protein, 127 aa, Artificial Sequence; identical to SEQ ID NO: 199
  Description of Artificial Sequence: Synthetic polypeptide

SEQ ID NO: 2160 - protein, 20 aa, Artificial Sequence
  Description of Artificial Sequence: Synthetic peptide
ARDSEYSSSWYSRGYYGMDV

SEQ ID NO: 2161 - protein, 110 aa, Artificial Sequence
  Description of Artificial Sequence: Synthetic polypeptide
QSVLTQPPSASGSPGQSVTISCTGTSSDVGGYNYVSWYQHHPGKAPKLMIFEVTKRPSGVPDRFSGSKSGNTASLTVSGLQAEDEADYYCYSYGGNNNAVFGGGTKLTVL

SEQ ID NO: 2162 - protein, 10 aa, Artificial Sequence
  Description of Artificial Sequence: Synthetic peptide
YSYGGNNNAV

SEQ ID NO: 2163 - protein, 120 aa, Artificial Sequence
  Description of Artificial Sequence: Synthetic polypeptide
QVQLQQWGAGLLKPSETLSRTCAVFGGSFTNYYWSWIRQSPGKGLEWIGEINDSGITNYNPSLKSRVTISVDTSKNQFSLSLRSVTAADTAVYYCARRRSFSRPSSIDYWGQGTLVTVSS

SEQ ID NO: 2164 - protein, 14 aa, Artificial Sequence
  Description of Artificial Sequence: Synthetic peptide
ARRRSFSRPSSIDY

SEQ ID NO: 2165 - protein, 111 aa, Artificial Sequence
  Description of Artificial Sequence: Synthetic polypeptide
DIVMTQSPLSLPVTPGEPASISCRSSQSLLHRNGYNYLDWYLQKPGQSPQLLIYLGSNRASGVPDRFRGSGSGTDFTLKISRVEAEDVGVYYCMQALQTLTFGQGTRLEIK

SEQ ID NO: 2166 - protein, 8 aa, Artificial Sequence
  Description of Artificial Sequence: Synthetic peptide
MQALQTLT

SEQ ID NO: 2167 - protein, 120 aa, Artificial Sequence; identical to SEQ ID NO: 2163
  Description of Artificial Sequence: Synthetic polypeptide

SEQ ID NO: 2168 - protein, 14 aa, Artificial Sequence
  Description of Artificial Sequence: Synthetic peptide
ARRRSFSRPSSIDY

SEQ ID NO: 2169 - protein, 111 aa, Artificial Sequence; identical to SEQ ID NO: 2165
  Description of Artificial Sequence: Synthetic polypeptide

SEQ ID NO: 2170 - protein, 8 aa, Artificial Sequence
  Description of Artificial Sequence: Synthetic peptide
MQALQTLT

SEQ ID NO: 2171 - protein, 120 aa, Artificial Sequence; identical to SEQ ID NO: 2163
  Description of Artificial Sequence: Synthetic polypeptide

SEQ ID NO: 2172 - protein, 14 aa, Artificial Sequence
  Description of Artificial Sequence: Synthetic peptide
ARRRSFSRPSSIDY

SEQ ID NO: 2173 - protein, 111 aa, Artificial Sequence
  Description of Artificial Sequence: Synthetic polypeptide
  MOD_RES (30)..(30): Any amino acid
DIVMTQSPLSLPVTPGEPASISCRSSQSLXHRNGYNYLDWYLQKPGQSPQLLIYLGSNRASGVPDRFRGSGSGTDFTLKISRVEAEDVGVYYCMQALQTLTFGQGTRLEIK

SEQ ID NO: 2174 - protein, 8 aa, Artificial Sequence
  Description of Artificial Sequence: Synthetic peptide
MQALQTLT

SEQ ID NO: 2175 - protein, 127 aa, Artificial Sequence; identical to SEQ ID NO: 199
  Description of Artificial Sequence: Synthetic polypeptide

SEQ ID NO: 2176 - protein, 20 aa, Artificial Sequence
  Description of Artificial Sequence: Synthetic peptide
ARDSEYSSSWYSRGYYGMDV

SEQ ID NO: 2177 - protein, 112 aa, Artificial Sequence; identical to SEQ ID NO: 200
  Description of Artificial Sequence: Synthetic polypeptide

SEQ ID NO: 2178 - protein, 9 aa, Artificial Sequence
  Description of Artificial Sequence: Synthetic peptide
MQALQTPPT

SEQ ID NO: 2179 - protein, 127 aa, Artificial Sequence; identical to SEQ ID NO: 199
  Description of Artificial Sequence: Synthetic polypeptide

SEQ ID NO: 2180 - protein, 20 aa, Artificial Sequence
  Description of Artificial Sequence: Synthetic peptide
ARDSEYSSSWYSRGYYGMDV

SEQ ID NO: 2181 - protein, 112 aa, Artificial Sequence; identical to SEQ ID NO: 200
  Description of Artificial Sequence: Synthetic polypeptide

SEQ ID NO: 2182 - protein, 9 aa, Artificial Sequence
  Description of Artificial Sequence: Synthetic peptide
MQALQTPPT

SEQ ID NO: 2183 - protein, 127 aa, Artificial Sequence; identical to SEQ ID NO: 199
  Description of Artificial Sequence: Synthetic polypeptide

SEQ ID NO: 2184 - protein, 20 aa, Artificial Sequence
  Description of Artificial Sequence: Synthetic peptide
ARDSEYSSSWYSRGYYGMDV

SEQ ID NO: 2185 - protein, 112 aa, Artificial Sequence; identical to SEQ ID NO: 200
  Description of Artificial Sequence: Synthetic polypeptide

SEQ ID NO: 2186 - protein, 9 aa, Artificial Sequence
  Description of Artificial Sequence: Synthetic peptide
MQALQTPPT

SEQ ID NO: 2187 - protein, 127 aa, Artificial Sequence; identical to SEQ ID NO: 199
  Description of Artificial Sequence: Synthetic polypeptide

SEQ ID NO: 2188 - protein, 20 aa, Artificial Sequence
  Description of Artificial Sequence: Synthetic peptide
ARDSEYSSSWYSRGYYGMDV

SEQ ID NO: 2189 - protein, 112 aa, Artificial Sequence; identical to SEQ ID NO: 200
  Description of Artificial Sequence: Synthetic polypeptide

SEQ ID NO: 2190 - protein, 9 aa, Artificial Sequence
  Description of Artificial Sequence: Synthetic peptide
MQALQTPPT

SEQ ID NO: 2191 - protein, 126 aa, Artificial Sequence
  Description of Artificial Sequence: Synthetic polypeptide
EVQLVESGGGLVKPGRSLRLSCTASGFTFGDYAMSWFRQAPGKGLEWVGFIRSKAYGGTTEYAASVKGRFTISRDDSKSIAYLQMNSLKTEDTAVYYCTRARSVTMVWYRYYMDVWGKGTTVTVSS

SEQ ID NO: 2192 - protein, 17 aa, Artificial Sequence
  Description of Artificial Sequence: Synthetic peptide
TRARSVTMVWYRYYMDV

SEQ ID NO: 2193 - protein, 112 aa, Artificial Sequence
  Description of Artificial Sequence: Synthetic polypeptide
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPYTFGQGTKLEIK

SEQ ID NO: 2194 - protein, 9 aa, Artificial Sequence
  Description of Artificial Sequence: Synthetic peptide
MQSIQLPYT

SEQ ID NO: 2195 - protein, 120 aa, Artificial Sequence
  Description of Artificial Sequence: Synthetic polypeptide
QVQLQQWGAGLLKPSETLSRTCAVYGGSFTDYYWSWIRQSPGKGLEWIGEINHSGSTNYNPFLKSRVTLSVDTSKNQFSLKLDSLTVADTAIYYCARGAKGDSDWYFDLWGRGTLVTVSS

SEQ ID NO: 2196 - protein, 14 aa, Artificial Sequence
  Description of Artificial Sequence: Synthetic peptide
ARGAKGDSDWYFDL

SEQ ID NO: 2197 - protein, 109 aa, Artificial Sequence
  Description of Artificial Sequence: Synthetic polypeptide
EIVLTQSPATLSLSPGERATLSCRASQSVSNYLAWYQQKPGQAPRLLISDASNRATGVPDRFSGSGSGTDFTLTINSLEPEDFAVYYCQQGDNWPRMYTFGQGTKLQIK

SEQ ID NO: 2198 - protein, 11 aa, Artificial Sequence
  Description of Artificial Sequence: Synthetic peptide
QQGDNWPRMYT

SEQ ID NO: 2199 - protein, 117 aa, Artificial Sequence
  Description of Artificial Sequence: Synthetic polypeptide
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYHCARDLAVYGMDVWGQGTTVTVSS

SEQ ID NO: 2200 - protein, 11 aa, Artificial Sequence
  Description of Artificial Sequence: Synthetic peptide
ARDLAVYGMDV

SEQ ID NO: 2201 - protein, 108 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPVTFGQGTRLEIK

SEQ ID NO: 2202 - protein, 10 aa, Artificial Sequence
  Description of Artificial Sequence: Synthetic peptide
QQLNSYPPVT

SEQ ID NO: 2203 - protein, 127 aa, Artificial Sequence
  Description of Artificial Sequence: Synthetic polypeptide
QVQLQESGPGLVKPSETLSLTCTVSGASINSYYWTWIRQPPGKGLEWIGYIHDSGNTNYNPALRSRVTISLDTSKNQFSLKVRSVTAADTAVYYCAREVVVQSAKDWSHYYYYMDVWGKGTTVSVSS

SEQ ID NO: 2204 - protein, 21 aa, Artificial Sequence
  Description of Artificial Sequence: Synthetic peptide
AREVVVQSAKDWSHYYYYMDV

SEQ ID NO: 2205 - protein, 107 aa, Artificial Sequence
  Description of Artificial Sequence: Synthetic polypeptide
EIVLTQSPATLSLSPGERASLSCRASQSVGTYLAWYQQKVGQPPRLLIYDASNRATGIPARFSGSGSGTDFTLTISSLDPEDFAVYYCQQRSSWFVTFGQGTRLEIK

SEQ ID NO: 2206 - protein, 9 aa, Artificial Sequence
  Description of Artificial Sequence: Synthetic peptide
QQRSSWFVT

SEQ ID NO: 2207 - protein, 127 aa, Artificial Sequence; identical to SEQ ID NO: 2203
  Description of Artificial Sequence: Synthetic polypeptide

SEQ ID NO: 2208 - protein, 21 aa, Artificial Sequence
  Description of Artificial Sequence: Synthetic peptide
AREVVVQSAKDWSHYYYYMDV

SEQ ID NO: 2209 - protein, 107 aa, Artificial Sequence; identical to SEQ ID NO: 2205
  Description of Artificial Sequence: Synthetic polypeptide

SEQ ID NO: 2210 - protein, 9 aa, Artificial Sequence
  Description of Artificial Sequence: Synthetic peptide
QQRSSWFVT

SEQ ID NO: 2211 - protein, 127 aa, Artificial Sequence; identical to SEQ ID NO: 2203
  Description of Artificial Sequence: Synthetic polypeptide

SEQ ID NO: 2212 - protein, 21 aa, Artificial Sequence
  Description of Artificial Sequence: Synthetic peptide
AREVVVQSAKDWSHYYYYMDV

SEQ ID NO: 2213 - protein, 107 aa, Artificial Sequence; identical to SEQ ID NO: 2205
  Description of Artificial Sequence: Synthetic polypeptide

SEQ ID NO: 2214 - protein, 9 aa, Artificial Sequence
  Description of Artificial Sequence: Synthetic peptide
QQRSSWFVT

SEQ ID NO: 2215 - protein, 127 aa, Artificial Sequence; identical to SEQ ID NO: 2203
  Description of Artificial Sequence: Synthetic polypeptide

SEQ ID NO: 2216 - protein, 21 aa, Artificial Sequence
  Description of Artificial Sequence: Synthetic peptide
AREVVVQSAKDWSHYYYYMDV

SEQ ID NO: 2217 - protein, 107 aa, Artificial Sequence; identical to SEQ ID NO: 2205
  Description of Artificial Sequence: Synthetic polypeptide

SEQ ID NO: 2218 - protein, 9 aa, Artificial Sequence
  Description of Artificial Sequence: Synthetic peptide
QQRSSWFVT

SEQ ID NO: 2219 - protein, 127 aa, Artificial Sequence
  Description of Artificial Sequence: Synthetic polypeptide
QVQLQESGPGLVKPSETLSLTCTVSGGSMTSYYWNWIRHTPGKDLEWIGYIDYSGNTNYNPSLRSRGTISVDTSKNQFSLRVTSVTAADTAVYYCAREVVVSSPKDWSHYYYYMDVWGKGTTVTVSS

SEQ ID NO: 2220 - protein, 21 aa, Artificial Sequence
  Description of Artificial Sequence: Synthetic peptide
AREVVVSSPKDWSHYYYYMDV

SEQ ID NO: 2221 - protein, 107 aa, Artificial Sequence
  Description of Artificial Sequence: Synthetic polypeptide
EIVLTQSPATLSLSPGERATLSCRASQSVSTYLTWYQQKPGQAPRLLIYDASNRATGIPARFSGSGSGTDFTLTITSLEPEDFALYYCQQRSTWFVTFGQGTRLEIK

SEQ ID NO: 2222 - protein, 9 aa, Artificial Sequence
  Description of Artificial Sequence: Synthetic peptide
QQRSTWFVT

SEQ ID NO: 2223 - protein, 120 aa, Artificial Sequence; identical to SEQ ID NO: 1195
  Description of Artificial Sequence: Synthetic polypeptide

SEQ ID NO: 2224 - protein, 13 aa, Artificial Sequence
  Description of Artificial Sequence: Synthetic peptide
TRDDSSWPHFFDN

SEQ ID NO: 2225 - protein, 108 aa, Artificial Sequence
  Description of Artificial Sequence: Synthetic polypeptide
DIQMTQSPSSLSASVGDRVTITCRASQSIINYLNWYQQKPGKAPKLLIYTASSLQSGVPSRFSGSGSGTDFTLTISSLQPEDFATYFCQQSYSSPLWTFGQGTKVEIK

SEQ ID NO: 2226 - protein, 10 aa, Artificial Sequence
  Description of Artificial Sequence: Synthetic peptide
QQSYSSPLWT

SEQ ID NO: 2227 - protein, 120 aa, Artificial Sequence
  Description of Artificial Sequence: Synthetic polypeptide
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGTTFNHYYYMDVWGKGTTVTVSS

SEQ ID NO: 2228 - protein, 14 aa, Artificial Sequence
  Description of Artificial Sequence: Synthetic peptide
ARGTTFNHYYYMDV

SEQ ID NO: 2229 - protein, 108 aa, Artificial Sequence
  Description of Artificial Sequence: Synthetic polypeptide
  MOD_RES (20)..(20): Any amino acid
DIQMTQSPSSLSASVGDRVXITCRASQSISSYLNWYQQKPGKAPKLLIYAASSLQSGVPSRFSGSGSGTDFTLTISSLQPEDFATYYCQQSYSTPPWTFGQGTKVEIK

SEQ ID NO: 2230 - protein, 10 aa, Artificial Sequence
  Description of Artificial Sequence: Synthetic peptide
QQSYSTPPWT

SEQ ID NO: 2231 - protein, 122 aa, Artificial Sequence
  Description of Artificial Sequence: Synthetic polypeptide
QVQLQQWGAGLLKPSETLSLTCAVYGGSFSGYYWSWIRQPPGKGLEWIGEVNHSGSTNYNPSLKSRVTISVDTSKNQFFLKLSSVTAADTAVYYCARHWMPRDYYYYGMDVWGQGTTVTVSS

SEQ ID NO: 2232 - protein, 16 aa, Artificial Sequence
  Description of Artificial Sequence: Synthetic peptide
ARHWMPRDYYYYGMDV

SEQ ID NO: 2233 - protein, 107 aa, Artificial Sequence; identical to SEQ ID NO: 909
  Description of Artificial Sequence: Synthetic polypeptide

SEQ ID NO: 2234 - protein, 9 aa, Artificial Sequence
  Description of Artificial Sequence: Synthetic peptide
QQSYSTPRT

SEQ ID NO: 2235 - protein, 121 aa, Artificial Sequence
  Description of Artificial Sequence: Synthetic polypeptide
QVQLQQWGAGLLKPSETLSRTCGVYGGSFRDYYWSWIRQSPGKGLEWIGEINHSGSTNYNPSLLGRVTISVDTSKNQFSLRLTSVTAADTAVYYCARAYVSSVSEDYFDYWGQGTLVTVSS

SEQ ID NO: 2236 - protein, 15 aa, Artificial Sequence
  Description of Artificial Sequence: Synthetic peptide
ARAYVSSVSEDYFDY

SEQ ID NO: 2237 - protein, 107 aa, Artificial Sequence
  Description of Artificial Sequence: Synthetic polypeptide
DIQMTQSPSSLSASVGDRVTITCRASQSISTYLNWYQQKPGKAPELLIYAASSFQSGVPSRFSGSGSGTDFTLTIRSLEPEDSATYYCQQSYTTPYTFGQGTKLEIK

SEQ ID NO: 2238 - protein, 9 aa, Artificial Sequence
  Description of Artificial Sequence: Synthetic peptide
QQSYTTPYT

SEQ ID NO: 2239 - protein, 118 aa, Artificial Sequence
  Description of Artificial Sequence: Synthetic polypeptide
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARDGEGQRETDYWGQGTLVTVSS

SEQ ID NO: 2240 - protein, 12 aa, Artificial Sequence
  Description of Artificial Sequence: Synthetic peptide
ARDGEGQRETDY

SEQ ID NO: 2241 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPRTFGQGTKVEIK

SEQ ID NO: 2242 - protein, 9 aa, Artificial Sequence
  Description of Artificial Sequence: Synthetic peptide
QQYDNLPRT

SEQ ID NO: 2243 - protein, 120 aa, Artificial Sequence; identical to SEQ ID NO: 1195
  Description of Artificial Sequence: Synthetic polypeptide

SEQ ID NO: 2244 - protein, 13 aa, Artificial Sequence
  Description of Artificial Sequence: Synthetic peptide
TRDDSSWPHFFDN

SEQ ID NO: 2245 - protein, 106 aa, Artificial Sequence
  Description of Artificial Sequence: Synthetic polypeptide
EIVMTQSPATLSVSPGERATLSCRASQSVSSNLAWYHQKPGQAPRLLIYGASTRATGIPARFSGSGSGTEFTLTISSLQSEDFAVYYCQQYDNWPLFGQGTRLEIK

SEQ ID NO: 2246 - protein, 8 aa, Artificial Sequence
  Description of Artificial Sequence: Synthetic peptide
QQYDNWPL

SEQ ID NO: 2247 - protein, 120 aa, Artificial Sequence; identical to SEQ ID NO: 1815
  Description of Artificial Sequence: Synthetic polypeptide

SEQ ID NO: 2248 - protein, 13 aa, Artificial Sequence
  Description of Artificial Sequence: Synthetic peptide
ARDVASNYAYFDL

SEQ ID NO: 2249 - protein, 106 aa, Artificial Sequence
  Description of Artificial Sequence: Synthetic polypeptide
EIVMTQSPATLSLSPGERATLSCRASQSVSSNLAWYHQKPGQAPRLLIYGASTRATGIPARFSGSGSGTEFTLTISSLQSEDFAVYYCQQYDNWPLFGQGTRLEIK

SEQ ID NO: 2250 - protein, 8 aa, Artificial Sequence
  Description of Artificial Sequence: Synthetic peptide
QQYDNWPL

SEQ ID NO: 2251 - protein, 123 aa, Artificial Sequence
  Description of Artificial Sequence: Synthetic polypeptide
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAANHCSGGSCYDGFDIWGQGTMVTVSS

SEQ ID NO: 2252 - protein, 16 aa, Artificial Sequence
  Description of Artificial Sequence: Synthetic peptide
AANHCSGGSCYDGFDI

SEQ ID NO: 2253 - protein, 108 aa, Artificial Sequence
  Description of Artificial Sequence: Synthetic polypeptide
EIVLTQSPGTLSLSPGERATLSCRASQSVSSSYLAWYQQRPGQAPRLLIYGASSRATGIPDRFSGSGSGTDFTLTISRLEPEDFAVYYCQQYGSSPWMFGQGTKVEIK

SEQ ID NO: 2254 - protein, 9 aa, Artificial Sequence
  Description of Artificial Sequence: Synthetic peptide
QQYGSSPWM

SEQ ID NO: 2255 - protein, 123 aa, Artificial Sequence
  Description of Artificial Sequence: Synthetic polypeptide
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAPYCSGGSCNDAFDIWGQGTMVTVSS

SEQ ID NO: 2256 - protein, 16 aa, Artificial Sequence
  Description of Artificial Sequence: Synthetic peptide
AAPYCSGGSCNDAFDI

SEQ ID NO: 2257 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2258 - protein, 9 aa, Artificial Sequence
  Description of Artificial Sequence: Synthetic peptide
QQYGSSPWT

SEQ ID NO: 2259 - protein, 128 aa, Artificial Sequence
  Description of Artificial Sequence: Synthetic polypeptide
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDVGADSSSAYYYYYMDVWGKGTTVTVSS

SEQ ID NO: 2260 - protein, 19 aa, Artificial Sequence
  Description of Artificial Sequence: Synthetic peptide
TTDVGADSSSAYYYYYMDV

SEQ ID NO: 2261 - protein, 108 aa, Artificial Sequence
  Description of Artificial Sequence: Synthetic polypeptide
  MOD_RES (9)..(9): Any amino acid
EIVLTQSPXSLSLSPGERATLSCGASQSVSSSYLAWYQQKPGLAPRLLIYDASSRATGIPDRFSGSGSGTDFTLTISRLEPEDFAVYYCQQYGSSPYTFGQGTKLEIK

SEQ ID NO: 2262 - protein, 9 aa, Artificial Sequence
  Description of Artificial Sequence: Synthetic peptide
QQYGSSPYT

SEQ ID NO: 2263 - protein, 117 aa, Artificial Sequence
  Description of Artificial Sequence: Synthetic polypeptide
EVQLVQSGPVLVKPGPSVKISCKASGFTFTDYYMHWVKQSHGKSLEWIGLVYPYNGGTSYNQKFKGKATLTVDTSSSTAYMELNSLTSEDSAVYYCARSGPDYFDYWGQGTTLTVSS

SEQ ID NO: 2264 - protein, 10 aa, Artificial Sequence
  Description of Artificial Sequence: Synthetic peptide
ARSGPDYFDY

SEQ ID NO: 2265 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPRTFGGGTKVEIK

SEQ ID NO: 2266 - protein, 9 aa, Artificial Sequence
  Description of Artificial Sequence: Synthetic peptide
QQYNNWPRT

SEQ ID NO: 2267 - protein, 122 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRFEDTAVYYCARDPSGSYPHNWFDPWGQGTLVTVSS

SEQ ID NO: 2268 - protein, 15 aa, Artificial Sequence
  Description of Artificial Sequence: Synthetic peptide
ARDPSGSYPHNWFDP

SEQ ID NO: 2269 - protein, 110 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVFGGGTKLTVL

SEQ ID NO: 2270 - protein, 10 aa, Artificial Sequence
  Description of Artificial Sequence: Synthetic peptide
QSYDSSLSGV

SEQ ID NO: 2271 - protein, 119 aa, Artificial Sequence
  Description of Artificial Sequence: Synthetic polypeptide
QVQLQQWGAGLLKPSETMSLTCDVSGGSFSGYYWSWIRQPPGKGLEWIGDINHSGSTNYNASLKSRVSILVDTSKNQFSLKLSSVTAADTAVYYCARCYDVLTGLMDVWGQGTTVTVSS

SEQ ID NO: 2272 - protein, 13 aa, Artificial Sequence
  Description of Artificial Sequence: Synthetic peptide
ARCYDVLTGLMDV

SEQ ID NO: 2273 - protein, 110 aa, Artificial Sequence
  Description of Artificial Sequence: Synthetic polypeptide
SYVLTQPPSVSVAPGKTARITCGGDYIGSKNVHWYQQKPGQAPVLVISYDTDRPSGIPERLSGSNSGNTATLTISRVEAGDEADYYCQVWDSTTGHPGVVFGGGTKLTVL

SEQ ID NO: 2274 - protein, 13 aa, Artificial Sequence
  Description of Artificial Sequence: Synthetic peptide
QVWDSTTGHPGVV

SEQ ID NO: 2275 - protein, 124 aa, Artificial Sequence
  Description of Artificial Sequence: Synthetic polypeptide
QVQLQESGPGLVKPSQTLSLTCTVSGGSISSSNYYWSWIRQHPGKGLDWIGYIFYSGSTYYNPSLKSRLTIAVDTSENQFSLKLSSVTAADTAVYYCARICRSTSCFYGAFDIWGQGTMVTVSS

SEQ ID NO: 2276 - protein, 16 aa, Artificial Sequence
  Description of Artificial Sequence: Synthetic peptide
ARICRSTSCFYGAFDI

SEQ ID NO: 2277 - protein, 108 aa, Artificial Sequence
  Description of Artificial Sequence: Synthetic polypeptide
  MOD_RES (108)..(108): Any amino acid
QSVLTQPASVSGSPGQSITISCTGTSSDVGSYNLVSWYQQHPGKAPKLIIYEVTKRPSGVSNRFSGSKSGNTASLTISGLQAEDEADYYCCSYARIITLFGGGTKLTX

SEQ ID NO: 2278 - protein, 9 aa, Artificial Sequence
  Description of Artificial Sequence: Synthetic peptide
CSYARIITL

SEQ ID NO: 2279 - protein, 125 aa, Artificial Sequence
  Description of Artificial Sequence: Synthetic polypeptide
QLQLQESGPGLVKPSETLSLTCTVSGGSISSSNYYWGWIRQPPGKGLEWIGNIYYSGITYYIPSLKSRVTISVDTSKNQFSLKLSSVTAADTALYYCARFDRYCSSTICYAFDGWGQGTLVTVST

SEQ ID NO: 2280 - protein, 17 aa, Artificial Sequence
  Description of Artificial Sequence: Synthetic peptide
ARFDRYCSSTICYAFDG

SEQ ID NO: 2281 - protein, 109 aa, Artificial Sequence
  Description of Artificial Sequence: Synthetic polypeptide
QSVLTQPASVSGSPGQSITISCTGTSSDIGSYDFVSWYQQHPGKAPKLMVYEVNKRPSGISNRFSGSKSGNTASLTISGLQAEDEADYHCCSYAGTTTLFGGGTKVTVL

SEQ ID NO: 2282 - protein, 9 aa, Artificial Sequence
  Description of Artificial Sequence: Synthetic peptide
CSYAGTTTL

SEQ ID NO: 2283 - protein, 119 aa, Artificial Sequence
  Description of Artificial Sequence: Synthetic polypeptide
QVQLQESGPGLVKPSGTLSLICAVSGGSISSNKWWSWVRQSPGKGLEWIGEIFHNGNTNYNPSLKSRVTISIDKSKNQFSLKLNSVTAADTAVYYCTRVMLGFGEFDYWGQGTLVTVSS

SEQ ID NO: 2284 - protein, 12 aa, Artificial Sequence
  Description of Artificial Sequence: Synthetic peptide
TRVMLGFGEFDY

SEQ ID NO: 2285 - protein, 110 aa, Artificial Sequence
  Description of Artificial Sequence: Synthetic polypeptide
QSVLTQPASVSGSPGQSITISCTGTSSDVGTYNYVSWYQQHPGKAPKLILYDVSDRPSGVSNRFSGSKSGNTASLTISGLQAEDEADYYCSAYTGSSPLYVFGGGTKVTV

SEQ ID NO: 2286 - protein, 11 aa, Artificial Sequence
  Description of Artificial Sequence: Synthetic peptide
SAYTGSSPLYV

SEQ ID NO: 2287 - protein, 126 aa, Artificial Sequence
  Description of Artificial Sequence: Synthetic polypeptide
EVQLVQSGAEVKKPGESLRISCKGSGYTFTNYWISWVRQMPGKGLEWMGTITLIDSDTNYSPSFQGLVTISDDRSSSTAYLQWSSLKTSDTAMYYCARHSQGYNYGAWYYSGLHVWGQGTTVTVSS

SEQ ID NO: 2288 - protein, 19 aa, Artificial Sequence
  Description of Artificial Sequence: Synthetic peptide
ARHSQGYNYGAWYYSGLHV

SEQ ID NO: 2289 - protein, 110 aa, Artificial Sequence
  Description of Artificial Sequence: Synthetic polypeptide
QSVLTQPPSASATPGQRVTVSCSGSSSNIGSNTVNWYQHLPETAPKLLIYSNNQRPSGVPDRFSGSKSGTSASLAISGLQSEDEADYYCEAWDDSVLGPVFGGGTKLTVL

SEQ ID NO: 2290 - protein, 11 aa, Artificial Sequence
  Description of Artificial Sequence: Synthetic peptide
EAWDDSVLGPV

SEQ ID NO: 2291 - protein, 128 aa, Artificial Sequence; identical to SEQ ID NO: 63
  Description of Artificial Sequence: Synthetic polypeptide

SEQ ID NO: 2292 - protein, 21 aa, Artificial Sequence
  Description of Artificial Sequence: Synthetic peptide
AKNIAEMSTFDDYFYYYGMDV

SEQ ID NO: 2293 - protein, 107 aa, Artificial Sequence
  Description of Artificial Sequence: Synthetic polypeptide
SYVLTQPPSVSVSPGQTASITCSGDKLGDKYACWYQQKPGQSPVMVIYQDTKRPSGIPERFSGSNSGNTATLTISGTQAMDEADYYCQAWDSSTFYVFGTGTKVTVL

SEQ ID NO: 2294 - protein, 10 aa, Artificial Sequence
  Description of Artificial Sequence: Synthetic peptide
QAWDSSTFYV

SEQ ID NO: 2295 - protein, 121 aa, Artificial Sequence
  Description of Artificial Sequence: Synthetic polypeptide
QVQLVESGGGVVQPGRSLRLSCAASGFTFSNYAMHWVRQAPGKGLEWVAVISNDGSSKHYGDSVKGRFTNSRDNSKNTVFLQMNSLRAEDTAVYYCAREVSGTYEKDYFDYWGQGTLVAVS

SEQ ID NO: 2296 - protein, 15 aa, Artificial Sequence
  Description of Artificial Sequence: Synthetic peptide
AREVSGTYEKDYFDY

SEQ ID NO: 2297 - protein, 108 aa, Artificial Sequence
  Description of Artificial Sequence: Synthetic polypeptide
SYVLTQPPSVSVAPGKTASITCGGDSIGSKSVHWYQQKPGQAPVLVIYYDTDRPSGIPERFSGSNSGNTATLTISRAEAGDEADYYCQVWDSSPDHYVFGTGTRVTVL

SEQ ID NO: 2298 - protein, 11 aa, Artificial Sequence
  Description of Artificial Sequence: Synthetic peptide
QVWDSSPDHYV

SEQ ID NO: 2299 - protein, 122 aa, Artificial Sequence
  Description of Artificial Sequence: Synthetic polypeptide
QVQLQESGPGLVKPSQSLSLTCTVSGVSISSGDYYWSWIRQHPGKGLEWIGYIFYSGITYYNPSLKSQVIISVDTSKNQFSLKLSSVTAADTAVYYCARFSRLLGANWFDPWGQGTLVTVSS

SEQ ID NO: 2300 - protein, 14 aa, Artificial Sequence
  Description of Artificial Sequence: Synthetic peptide
ARFSRLLGANWFDP

SEQ ID NO: 2301 - protein, 108 aa, Artificial Sequence
  Description of Artificial Sequence: Synthetic polypeptide
QSVLTQPRSVSGSPGQSVTISCTGTSSDVGSYDYVSWYQQHPGKAPKLMIYDVTKRPSGVPDRFSGSKSGNTASLTISGLQAEDEADYYCCSYVGTVLFGGGTKLTVL

SEQ ID NO: 2302 - protein, 8 aa, Artificial Sequence
  Description of Artificial Sequence: Synthetic peptide
CSYVGTVL

SEQ ID NO: 2303 - protein, 128 aa, Artificial Sequence
  Description of Artificial Sequence: Synthetic polypeptide
QVQLVESGGGVVQPGRSLRLSCAASGFTFNSYGMHWVRQAPGKGLEWVAVIWYDGSNEYYADSVKGRITISRDNSKNTLYLQMNSLRAEDTAVYYCARDPLRDILTGYHYKYYYMDVWGKGTTVTVSS

SEQ ID NO: 2304 - protein, 21 aa, Artificial Sequence
  Description of Artificial Sequence: Synthetic peptide
ARDPLRDILTGYHYKYYYMDV

SEQ ID NO: 2305 - protein, 110 aa, Artificial Sequence
  Description of Artificial Sequence: Synthetic polypeptide
QSVLTQPPSASATPGQRVTISCSGSSSNIGSDTVNWYQQLPGTAPKLLIYSNDQRPSGVPDRFSGSKSGTSASLAISGLQSEDEADYYCSTWDDGLNGVVFGGGTKLTVL

SEQ ID NO: 2306 - protein, 11 aa, Artificial Sequence
  Description of Artificial Sequence: Synthetic peptide
STWDDGLNGVV

SEQ ID NO: 2307 - protein, 122 aa, Artificial Sequence; identical to SEQ ID NO: 77
  Description of Artificial Sequence: Synthetic polypeptide

SEQ ID NO: 2308 - protein, 15 aa, Artificial Sequence
  Description of Artificial Sequence: Synthetic peptide
AKGGDRAMGPEYFDS

SEQ ID NO: 2309 - protein, 110 aa, Artificial Sequence
  Description of Artificial Sequence: Synthetic polypeptide
QSVLTQPASVSGSPGQSITISCTGTSSDVGANNYVSWYQQHPGKAPKLMIYDVNERPSGVSNRFSGSKSGNTASLTISGLQTEDEADYYCSSFASSSTLLFGGGTKLTVL

SEQ ID NO: 2310 - protein, 10 aa, Artificial Sequence
  Description of Artificial Sequence: Synthetic peptide
SSFASSSTLL

SEQ ID NO: 2311 - protein, 128 aa, Artificial Sequence
  Description of Artificial Sequence: Synthetic polypeptide
QVQLQESGPGLVKPSQTLSLTCAVSGVSINSGDYYWTWIRQHPGKGLEWIGYIYYSGVTYYNPSLKSRVTISVDTSKSQFSLKLSSVTAADTATYYCARVARSFYDSSGYYPGAFDIWGQGTMVTVSS

SEQ ID NO: 2312 - protein, 20 aa, Artificial Sequence
  Description of Artificial Sequence: Synthetic peptide
ARVARSFYDSSGYYPGAFDI

SEQ ID NO: 2313 - protein, 109 aa, Artificial Sequence
  Description of Artificial Sequence: Synthetic polypeptide
QSVLTQPASVAGSPGQSVTISCTGTSSDVGSYDLVSWYQQHPGKAPKLMIFEVSKRPSGVSPRFSASKSGNTASLTISGLQPEDEADYYCCSYAPSYTSFGGGTKLTVL

SEQ ID NO: 2314 - protein, 9 aa, Artificial Sequence
  Description of Artificial Sequence: Synthetic peptide
CSYAPSYTS

SEQ ID NO: 2315 - protein, 122 aa, Artificial Sequence
  Description of Artificial Sequence: Synthetic polypeptide
QVQLVQSGAEVKRPGASVKVSCKTSGYTFTNYYIHWVRQAPGQGLEWVGMINPDGGSTSTAQKFQGRVTMTADTSTSTVYMELSSLRSEDAAVYFCARDFFLIPAQAGFDYWGQGTLVTVSS

SEQ ID NO: 2316 - protein, 15 aa, Artificial Sequence
  Description of Artificial Sequence: Synthetic peptide
ARDFFLIPAQAGFDY

SEQ ID NO: 2317 - protein, 110 aa, Artificial Sequence
  Description of Artificial Sequence: Synthetic polypeptide
QSVLTQPASVSGSPGQSITISCTGTNSDVGSYNLVSWYQQHPGKAPKLMIYEVTKRPSGVSNRFSGSKSGHTASLTISGLQAEDEADYYCCSYASSRTWVFGGGTKLTVL

SEQ ID NO: 2318 - protein, 10 aa, Artificial Sequence
  Description of Artificial Sequence: Synthetic peptide
CSYASSRTWV

SEQ ID NO: 2319 - protein, 115 aa, Artificial Sequence
  Description of Artificial Sequence: Synthetic polypeptide
EVQLVESGGGLVQPGGSLRLSCSASGFTFSTYSMHWVRQAPGKGLEYVSAISNNGGSTYYADSVKGRFTISRDNSKNTLYLQMSSLRAEDTAVYYCVTWELNDYWGQGTLVTVSS

SEQ ID NO: 2320 - protein, 8 aa, Artificial Sequence
  Description of Artificial Sequence: Synthetic peptide
VTWELNDY

SEQ ID NO: 2321 - protein, 110 aa, Artificial Sequence
  Description of Artificial Sequence: Synthetic polypeptide
QSVLTQPASVSGSPGQSITISCTGTSSDVGGYYSVSWYQQHPGKAPKLMIYDVTNRPSGVSDRFSGSKSGNTASLTISGLQAEDEADYYCSSFTTSTTRVFGGGTKLAVL

SEQ ID NO: 2322 - protein, 10 aa, Artificial Sequence
  Description of Artificial Sequence: Synthetic peptide
SSFTTSTTRV

SEQ ID NO: 2323 - protein, 123 aa, Artificial Sequence
  Description of Artificial Sequence: Synthetic polypeptide
EVQLVESGGALVQPGGSLRLSCAASGFTFSSYSMNWVRQAPGKGLEWISYISRSSGSIYYADSVKGRFTISRDNAKISLYLQMNSLRAEDTAVYYCARMRGSTYDGEDYFDLWGQGTLVTVSS

SEQ ID NO: 2324 - protein, 16 aa, Artificial Sequence
  Description of Artificial Sequence: Synthetic peptide
ARMRGSTYDGEDYFDL

SEQ ID NO: 2325 - protein, 109 aa, Artificial Sequence
  Description of Artificial Sequence: Synthetic polypeptide
SYVLTQPPSVSVAPGQTARITCGGNNIGSKSVHWYQQKPGQAPVLVIYYDSDRPSGIPERFSGSNSGNTATLTIRRVEAGDEADYYCQVWDGSSDLPWVFGGGTKLTVL

SEQ ID NO: 2326 - protein, 12 aa, Artificial Sequence
  Description of Artificial Sequence: Synthetic peptide
QVWDGSSDLPWV

SEQ ID NO: 2327 - protein, 127 aa, Artificial Sequence
  Description of Artificial Sequence: Synthetic polypeptide
QVQLQESGPGLVKPSQTLSLTCTVSGGSISSGDYYWSWIRQPPGQGLECIGYIYYRGSTYYNPSLKSRVTMSVDTSKNQFSLNLTSVTAADTAVYYCARVRYCSGSSCLDNNWFDPWGQGTLVTVSS

SEQ ID NO: 2328 - protein, 19 aa, Artificial Sequence
  Description of Artificial Sequence: Synthetic peptide
ARVRYCSGSSCLDNNWFDP

SEQ ID NO: 2329 - protein, 111 aa, Artificial Sequence
  Description of Artificial Sequence: Synthetic polypeptide
QSVLTQPPSVSGAPGQRVTISCTGSSSNIGTGYGVHWYQRLPGTAPKLLIYGNSNRPSGVPDRFSGSRSGTSASLAITGLQAEDEGDYYCQSYDSSLSDVLFGGGTKLTVL

SEQ ID NO: 2330 - protein, 11 aa, Artificial Sequence
  Description of Artificial Sequence: Synthetic peptide
QSYDSSLSDVL

SEQ ID NO: 2331 - protein, 117 aa, Artificial Sequence
  Description of Artificial Sequence: Synthetic polypeptide
QVQLQESGPGLVKPSGTLSLSCTVTGGSISSNNWWSWVRQSPVKGLEWIGEIYHNGNINYNPSLKSRVTMSIDKSKNHFSLKLSSVTAADTAVYYCARGDVLDWFDPWGQGTLVTVS

SEQ ID NO: 2332 - protein, 11 aa, Artificial Sequence
  Description of Artificial Sequence: Synthetic peptide
ARGDVLDWFDP

SEQ ID NO: 2333 - protein, 110 aa, Artificial Sequence; identical to SEQ ID NO: 60
  Description of Artificial Sequence: Synthetic polypeptide

SEQ ID NO: 2334 - protein, 10 aa, Artificial Sequence
  Description of Artificial Sequence: Synthetic peptide
SSYAGNSTVR

SEQ ID NO: 2335 - protein, 124 aa, Artificial Sequence
  Description of Artificial Sequence: Synthetic polypeptide
QVQLVESGGGVVQPGRSLRLSCAASGFTFSSYAIHWVRQAPGKGLEWVAVISFDGSNKYYRDSVKGRFTISRDNGKNTLYLQMNSLRAEDTAVYYCAKAALGYCTNGVCYCDNWGQGTLVTVSS

SEQ ID NO: 2336 - protein, 17 aa, Artificial Sequence
  Description of Artificial Sequence: Synthetic peptide
AKAALGYCTNGVCYCDN

SEQ ID NO: 2337 - protein, 111 aa, Artificial Sequence; identical to SEQ ID NO: 68
  Description of Artificial Sequence: Synthetic polypeptide

SEQ ID NO: 2338 - protein, 10 aa, Artificial Sequence
  Description of Artificial Sequence: Synthetic peptide
QSYDINSLWV

SEQ ID NO: 2339 - protein, 118 aa, Artificial Sequence
  Description of Artificial Sequence: Synthetic polypeptide
QVQLQESGPGLVKPSGTLSLTCAVSGGSINSTHWWSWVRQPPGKGLEWIGEIHHGGNTNYNPSLKSRATISVDRSKNQFSMKLTSVNAADTAVYYCARDTWSMGAGPWGQGTLVTVSS

SEQ ID NO: 2340 - protein, 11 aa, Artificial Sequence
  Description of Artificial Sequence: Synthetic peptide
ARDTWSMGAGP

SEQ ID NO: 2341 - protein, 109 aa, Artificial Sequence
  Description of Artificial Sequence: Synthetic polypeptide
QSALTQPASVSGSPGQSITISCTGTSSDVGAYNYVSWYQQHPGEAPKLIIYDVSDRPSGVSNRFSGSKSGNTASLTISGLQAEDEADYHCSSYTSSSTLFGGGTKVTVL

SEQ ID NO: 2342 - protein, 9 aa, Artificial Sequence
  Description of Artificial Sequence: Synthetic peptide
SSYTSSSTL

SEQ ID NO: 2343 - protein, 127 aa, Artificial Sequence
  Description of Artificial Sequence: Synthetic polypeptide
QVQLQESGPGLVKPSQTLSLTCSVSGGSISSGNYYWSWIRQRPGKGLEWIGNIFYSGITYYNPSLKSPVTISVDTSKSQFSLKLTSVSAADTAVYYCARLCRFAADSTNCYSAFDIWGQGTMVTVSS

SEQ ID NO: 2344 - protein, 19 aa, Artificial Sequence
  Description of Artificial Sequence: Synthetic peptide
ARLCRFAADSTNCYSAFDI

SEQ ID NO: 2345 - protein, 108 aa, Artificial Sequence
  Description of Artificial Sequence: Synthetic polypeptide
QSVLTQPASVSGSPGQSITISCTGTSSDVGSYDLVSWYQQHPGKAPKLMIYEVSKRPSGISSRFSGSKSGNTASLTISGLQAEDEADYYCCSYTGNVVFGGGTKLTVL

SEQ ID NO: 2346 - protein, 8 aa, Artificial Sequence
  Description of Artificial Sequence: Synthetic peptide
CSYTGNVV

SEQ ID NO: 2347 - protein, 121 aa, Artificial Sequence
  Description of Artificial Sequence: Synthetic polypeptide
QVQLQESGPGLVKPSQTLSLACTVSGGSISGGAYYWSWIRQHPGKGLEWIGYIYYSANTYYNPSLQSRVTISVDTSKKQFSLKLTSVTAADTAIYYCAGFDVSYYDAFDIWGQGTMVTVSS

SEQ ID NO: 2348 - protein, 13 aa, Artificial Sequence
  Description of Artificial Sequence: Synthetic peptide
AGFDVSYYDAFDI

SEQ ID NO: 2349 - protein, 110 aa, Artificial Sequence
  Description of Artificial Sequence: Synthetic polypeptide
QSVLTQPRSVSGSPGQSVTISCTGTSSDVGVYNYVSWYQQHPGKAPKLIISNVHKRPSGVPDRFSGSKSGNTASLTISGLQAEDEAEYYCCSYAGSYVYVFGTGTTVTVL

SEQ ID NO: 2350 - protein, 10 aa, Artificial Sequence
  Description of Artificial Sequence: Synthetic peptide
CSYAGSYVYV

SEQ ID NO: 2351 - protein, 125 aa, Artificial Sequence
  Description of Artificial Sequence: Synthetic polypeptide
EVQLVESGGGLVQPGGSLRLSCAASGFTFSNFWMSWVRQPPGKGLEWVANINQDGSDEYFVGSVKGRFTISRDNAKNSLYLQMNNLRVEDTAVYYCARDQDVLVVGGTPEAFDIWGQGTMVTVSS

SEQ ID NO: 2352 - protein, 18 aa, Artificial Sequence
  Description of Artificial Sequence: Synthetic peptide
ARDQDVLVVGGTPEAFDI

SEQ ID NO: 2353 - protein, 106 aa, Artificial Sequence
  Description of Artificial Sequence: Synthetic polypeptide
SYVLTQPPSVSVSPGQTARITCSGDALPRQYVYWYQQRPGQAPVLVIYKDTERPSGIPERFSGSTSGTTVTLTISGVQADDEADYYCQSADSRGQVFGGGTKLTVL

SEQ ID NO: 2354 - protein, 9 aa, Artificial Sequence
  Description of Artificial Sequence: Synthetic peptide
QSADSRGQV

SEQ ID NO: 2355 - protein, 126 aa, Artificial Sequence
  Description of Artificial Sequence: Synthetic polypeptide
QLQLQESGPGLVKPSETLSLTCSVSGGSISSSNYYWVWIRQPPGKGLEWIGSIYYSGTTYYNPSLKSRVTISVDTSKNQFSLKVDTVTAADTAVYYCARLVRRFDFWEPPGGFDPWGQGTLVTVSS

SEQ ID NO: 2356 - protein, 18 aa, Artificial Sequence
  Description of Artificial Sequence: Synthetic peptide
ARLVRRFDFWEPPGGFDP

SEQ ID NO: 2357 - protein, 110 aa, Artificial Sequence
  Description of Artificial Sequence: Synthetic polypeptide
QSVLTQPASVSGSPGQSITISCTGTSSDVGSYDLVSWYQHHPGKAPKLMIYEVTKRPSGVSNRFSGSKSDNTASLTISGLQAEDEADYFCCSYVGSSTVLFGGGTKLTVL

SEQ ID NO: 2358 - protein, 10 aa, Artificial Sequence
  Description of Artificial Sequence: Synthetic peptide
CSYVGSSTVL

SEQ ID NO: 2359 - protein, 121 aa, Artificial Sequence
  Description of Artificial Sequence: Synthetic polypeptide
QLQLQESGPGLVKPSETLSLTCSVSGGSLSNTAYYWGWIRQPPGKGLEWIGSIYYSGNTYSNPSLKSRVTMSADRSKNQFSLKLSSVTAADTAVYYCLSGNYLPYSSLDYWGQGTLVTVSS

SEQ ID NO: 2360 - protein, 13 aa, Artificial Sequence
  Description of Artificial Sequence: Synthetic peptide
LSGNYLPYSSLDY

SEQ ID NO: 2361 - protein, 110 aa, Artificial Sequence
  Description of Artificial Sequence: Synthetic polypeptide
QSVLTQPASVSASPGQSITMSCTGTSSDVGTYNLVSWYQQHPGKAPKLLMFEVNKRPSGVSDRFSGSKSGNTASLTISGLQAEDEADYHCCSYAGNSTWVFGGGTKVTVL

SEQ ID NO: 2362 - protein, 10 aa, Artificial Sequence
  Description of Artificial Sequence: Synthetic peptide
CSYAGNSTWV

SEQ ID NO: 2363 - protein, 127 aa, Artificial Sequence
  Description of Artificial Sequence: Synthetic polypeptide
QVQLVESGGGVVQPGKSLRLSCAASGFTFASFAMHWVRQAPGKGLEWVSVISFDGSNKYYADSVKGRFTISRDNSKNTVHLQMTSLRAEDTALYFCARGDYYGSGTYFNPLPNFDYWGQGSLVTVSS

SEQ ID NO: 2364 - protein, 20 aa, Artificial Sequence
  Description of Artificial Sequence: Synthetic peptide
ARGDYYGSGTYFNPLPNFDY

SEQ ID NO: 2365 - protein, 111 aa, Artificial Sequence
  Description of Artificial Sequence: Synthetic polypeptide
QSVLTQPPSASGTPGQRVTISCSGSSSNIGTYPVNWYQYLPGTAPKLLIYSNNQRPSGVPDRFSGSKSGTSASLAISGLQSEDEADYFCAAWDDSLNVFWVFGGGTKLTVL

SEQ ID NO: 2366 - protein, 12 aa, Artificial Sequence
  Description of Artificial Sequence: Synthetic peptide
AAWDDSLNVFWV

SEQ ID NO: 2367 - protein, 127 aa, Artificial Sequence
  Description of Artificial Sequence: Synthetic polypeptide
QVQLVQSGAEVKKPGASVKVSCKASGYSFANYYMHWVRQAPRQGLEWIGIVNPSDGSTTYAQKFQGRVTITRDTSTSTVYMQVSSLKSDDTAVYYCARPKWELQPSGGYHYYQMDLWGRGTTVTVSS

SEQ ID NO: 2368 - protein, 20 aa, Artificial Sequence
  Description of Artificial Sequence: Synthetic peptide
ARPKWELQPSGGYHYYQMDL

SEQ ID NO: 2369 - protein, 109 aa, Artificial Sequence
  Description of Artificial Sequence: Synthetic polypeptide
QSVLTQPPSVSAAPGQNVTISCSGSTSNILFYYVSWYQHLPGTAPKLLIFDSNNRPSGIPDRFSGSKSGTSATLRITGLQTGDEADYYCGTWDSGLTAPVFGGGTKLTV

SEQ ID NO: 2370 - protein, 11 aa, Artificial Sequence
  Description of Artificial Sequence: Synthetic peptide
GTWDSGLTAPV

SEQ ID NO: 2371 - protein, 120 aa, Artificial Sequence
  Description of Artificial Sequence: Synthetic polypeptide
QVQLVQSGAEVKKPGASVKVSCKTSGYTFTNYGISWVRQAPGQGLEWMGWISGFNGNTKYAQKVQGRVTMTTDASTSTAYMELRSLRSDDTAVYYCARVMGIIVTGPTYWGQGTLVTVSS

SEQ ID NO: 2372 - protein, 13 aa, Artificial Sequence
  Description of Artificial Sequence: Synthetic peptide
ARVMGIIVTGPTY

SEQ ID NO: 2373 - protein, 110 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYSCQSYDGSTWVFGGGTKLTVL

SEQ ID NO: 2374 - protein, 9 aa, Artificial Sequence
  Description of Artificial Sequence: Synthetic peptide
QSYDGSTWV

SEQ ID NO: 2375 - protein, 122 aa, Artificial Sequence
  Description of Artificial Sequence: Synthetic polypeptide
QVQLQESGPGLVKPSQTLSLSCTVSGGSISSDDYYWSWIRQPPGKGLEWIGYIYYSGSTYYNSSLKSRVSISVDTSKNQFSLKLSSVTAADTAVYYCARWKRWLQFLYFDYWGQGTLVTVSS

SEQ ID NO: 2376 - protein, 14 aa, Artificial Sequence
  Description of Artificial Sequence: Synthetic peptide
ARWKRWLQFLYFDY

SEQ ID NO: 2377 - protein, 110 aa, Artificial Sequence
  Description of Artificial Sequence: Synthetic polypeptide
QSALTQPRSVSGSPGQSVTISCTGTSSDVGGYSFVSWYQQHPGKAPKVLIYDVDKRPSGVPDRLSGSKSGNTASLTISGLQAEDEADYYCCSYAGSYTLIFGGGTKLTVL

SEQ ID NO: 2378 - protein, 10 aa, Artificial Sequence
  Description of Artificial Sequence: Synthetic peptide
CSYAGSYTLI

SEQ ID NO: 2379 - protein, 121 aa, Artificial Sequence
  Description of Artificial Sequence: Synthetic polypeptide
QVQLVESGGGVVQPGRSLRLSCAASGFTFSTFGMHWVRQAPGKGLEWVAAIRYDGSDKYYVDSVKGRFTISRDNSKNALYLQMNSLRDEDTAVYYCAREDYYDSSGSFDYWGQGTLVTVSS

SEQ ID NO: 2380 - protein, 14 aa, Artificial Sequence
  Description of Artificial Sequence: Synthetic peptide
AREDYYDSSGSFDY

SEQ ID NO: 2381 - protein, 109 aa, Artificial Sequence
  Description of Artificial Sequence: Synthetic polypeptide
QSVLTQPRSVSGSPGQSVTISCTGTSSDVGGYNYVSWYQQHPGKAPKVMTYDVSKRPSGVPDRFSGSKSGNTASLTISGLQAEDEADYYCCSYAGRSWVFGGGTKLTVL

SEQ ID NO: 2382 - protein, 9 aa, Artificial Sequence
  Description of Artificial Sequence: Synthetic peptide
CSYAGRSWV

SEQ ID NO: 2383 - protein, 126 aa, Artificial Sequence
  Description of Artificial Sequence: Synthetic polypeptide
QLQLQESGPGLVKPSETLSLTCSVSGGSISSSSYYWGWIRQPPGKGLEWIGNIFYSGITYYNPSLKSRVTISVDTSKNQFSLKLSSVTAADTAVYYCARLPREYSSSSVYLVFDIWGQGTMVTVSS

SEQ ID NO: 2384 - protein, 18 aa, Artificial Sequence
  Description of Artificial Sequence: Synthetic peptide
ARLPREYSSSSVYLVFDI

SEQ ID NO: 2385 - protein, 109 aa, Artificial Sequence
  Description of Artificial Sequence: Synthetic polypeptide
QSVLTQPASVSGSPGQSITISCTGTSSDVGSYDLVSWYQQHPDKAPKLMIYEVSKRPSGISNRFSGSKSGNTASLTISGLQAEDEADYYCFSYVGSNILFGGGTKLTVL

SEQ ID NO: 2386 - protein, 9 aa, Artificial Sequence
  Description of Artificial Sequence: Synthetic peptide
FSYVGSNIL

SEQ ID NO: 2387 - protein, 127 aa, Artificial Sequence
  Description of Artificial Sequence: Synthetic polypeptide
QLQLQESGPGLVKPSETLSLTCTVSGGSISSSSYYWGWIRQPPGKGLEWIGSIFYSGSTYYKPSLRSRVTISVDTSKNQFSLKLSSVTAADTAVYYCARLARSFYDSSGYYPGAWYWGQGTLVTVSS

SEQ ID NO: 2388 - protein, 19 aa, Artificial Sequence
  Description of Artificial Sequence: Synthetic peptide
ARLARSFYDSSGYYPGAWY

SEQ ID NO: 2389 - protein, 108 aa, Artificial Sequence
  Description of Artificial Sequence: Synthetic polypeptide
QSVLTQPASMSGSPGQSITISCTGTSSDVGSYDLVSWYQQHPGKAPKLFIYEVAKRPSGVSYRFSGSKSGNTASLTISGLQAEDEADYYCCCYVGNNTMFGGGTKLTV

SEQ ID NO: 2390 - protein, 9 aa, Artificial Sequence
  Description of Artificial Sequence: Synthetic peptide
CCYVGNNTM

SEQ ID NO: 2391 - protein, 127 aa, Artificial Sequence
  Description of Artificial Sequence: Synthetic polypeptide
QVQLVQSGAEVKKPGASVKVSCKASGYSFATYYIHWVRQAPGQGLEWMGIIDPSGGSTNYAQKFQGRVTMTRDTSTSTVYLELSSLRSEDTAVYYCARADTPIVVDTTSYFYYMDVWGKGTTVTVSS

SEQ ID NO: 2392 - protein, 20 aa, Artificial Sequence
  Description of Artificial Sequence: Synthetic peptide
ARADTPIVVDTTSYFYYMDV

SEQ ID NO: 2393 - protein, 111 aa, Artificial Sequence
  Description of Artificial Sequence: Synthetic polypeptide
QSVLTQPASVSGSPGQSITISCTGTSRDIGFYKYVSWYQQHPGKAPKLIIYDVTNRPSGVSNRFSGSKSGNTASLTISGLQAEDEAHYHCSSYSTAYVHVLFGGGTRLTVL

SEQ ID NO: 2394 - protein, 11 aa, Artificial Sequence
  Description of Artificial Sequence: Synthetic peptide
SSYSTAYVHVL

SEQ ID NO: 2395 - protein, 123 aa, Artificial Sequence
  Description of Artificial Sequence: Synthetic polypeptide
EVQLVESGGGLVQPGGSLRLSCAASGFSVSTNYMSWVRQAPGKGLEWVSIIYRGDSTSYADSVKGRFTISRDSSKNTLFLQMNSLRAEDTAVYYCARDRSGYSYGLIHGMDVWGQGTTVTVSS

SEQ ID NO: 2396 - protein, 17 aa, Artificial Sequence
  Description of Artificial Sequence: Synthetic peptide
ARDRSGYSYGLIHGMDV

SEQ ID NO: 2397 - protein, 109 aa, Artificial Sequence
  Description of Artificial Sequence: Synthetic polypeptide
DIQMTQSPSSLSASVGDRVTITCRASESISNYLNWYQQKPGKAPKLLISAASNLQRGVPSRFSGSGSGTDFTLTISSLQPEDFATYYCQQSYSSPPVYTFGQGTKLEIK

SEQ ID NO: 2398 - protein, 11 aa, Artificial Sequence
  Description of Artificial Sequence: Synthetic peptide
QQSYSSPPVYT

SEQ ID NO: 2399 - protein, 124 aa, Artificial Sequence; identical to SEQ ID NO: 73
  Description of Artificial Sequence: Synthetic polypeptide

SEQ ID NO: 2400 - protein, 18 aa, Artificial Sequence
  Description of Artificial Sequence: Synthetic peptide
ARGGFGVVINYYYSGMDV

SEQ ID NO: 2401 - protein, 112 aa, Artificial Sequence; identical to SEQ ID NO: 74
  Description of Artificial Sequence: Synthetic polypeptide

SEQ ID NO: 2402 - protein, 9 aa, Artificial Sequence
  Description of Artificial Sequence: Synthetic peptide
MQALQTPPT

SEQ ID NO: 2403 - protein, 127 aa, Artificial Sequence
  Description of Artificial Sequence: Synthetic polypeptide
QVQLVESGGGVVQPGRSLRLSCAASGFTFSNYVMYWVRQAPGKGLEWVAIILYDGSDPNYADSVKGRFTISRDNSKNTLYLQMNSPRAEDTAVYYCAKGQDPYCAAGSCYSHYFDYWGQGTLVTVSS

SEQ ID NO: 2404 - protein, 20 aa, Artificial Sequence
  Description of Artificial Sequence: Synthetic peptide
AKGQDPYCAAGSCYSHYFDY

SEQ ID NO: 2405 - protein, 105 aa, Artificial Sequence
  Description of Artificial Sequence: Synthetic polypeptide
EIVLTQSPATLSLSPGERATLSCRASHSVSTYLAWYQQKFGQAPRLLIYDASNRATGIPARFSGSGSGTDFTLTISSLEPEDFAVYYCQQRNNWPTFGQGTRLEI

SEQ ID NO: 2406 - protein, 8 aa, Artificial Sequence
  Description of Artificial Sequence: Synthetic peptide
QQRNNWPT

SEQ ID NO: 2407 - protein, 120 aa, Artificial Sequence
  Description of Artificial Sequence: Synthetic polypeptide
EVQLVQSGAEVKKPGESLRISCKGSGYSFTNYWISWVRQMPGKGLEWMGRIDPSDSYTTYNPSFQGHVTISADKSISTAYLRWSSLKASDTAIYYCARIGAHYLHYMDVWGKGTTVTVSS

SEQ ID NO: 2408 - protein, 13 aa, Artificial Sequence
  Description of Artificial Sequence: Synthetic peptide
ARIGAHYLHYMDV

SEQ ID NO: 2409 - protein, 106 aa, Artificial Sequence
  Description of Artificial Sequence: Synthetic polypeptide
EIVMTQSPATLSVSPGERATLSCRASRSVSTNLAWYQQKPGQAPRLLIYGASTRATGIPARFSGSGSGTEFTLTISSLQSEDFVVYYCQHYNNWPLFGGGTKVEIK

SEQ ID NO: 2410 - protein, 8 aa, Artificial Sequence
  Description of Artificial Sequence: Synthetic peptide
QHYNNWPL

SEQ ID NO: 2411 - protein, 122 aa, Artificial Sequence
  Description of Artificial Sequence: Synthetic polypeptide
QVQLVQSGAEVKKPGASVKVSCKTSGYTFISYYIHWVRQAPGQGLEWMGIINPDGDNTNYAQKFQGRVTMTRDTSTSTVYMELSSLRFEDTAVYYCARGGAIPALRTAFDIWGQGTMVTVSS

SEQ ID NO: 2412 - protein, 15 aa, Artificial Sequence
  Description of Artificial Sequence: Synthetic peptide
ARGGAIPALRTAFDI

SEQ ID NO: 2413 - protein, 105 aa, Artificial Sequence
  Description of Artificial Sequence: Synthetic polypeptide
DIQMTQSPSTLSASVGDRVTITCRASQSISNWLAWYQQKPGKAPKLLIYKASSLESGVPSRFSGSGSGTEFTLTISSLQPDDFATYYCQEYNSYYFGQGTKLEIK

SEQ ID NO: 2414 - protein, 7 aa, Artificial Sequence
  Description of Artificial Sequence: Synthetic peptide
QEYNSYY

SEQ ID NO: 2415 - protein, 118 aa, Artificial Sequence
  Description of Artificial Sequence: Synthetic polypeptide
QVQLVQSGAEVKKPGASVKVSCRASGYTFTSYGINWVRQAPGQGLEWMGWISTYEGDTNYAQKLQGRVTMTTDTSTNTAYMELRSLRSDDTAVYYCATVTGNYLSDYWGQGTLVTVSS

SEQ ID NO: 2416 - protein, 11 aa, Artificial Sequence
  Description of Artificial Sequence: Synthetic peptide
ATVTGNYLSDY

SEQ ID NO: 2417 - protein, 109 aa, Artificial Sequence
  Description of Artificial Sequence: Synthetic polypeptide
EIVMTQSPATLSVSPGETATLSCRASQSVSSNLAWYQHKPGQAPRLLIYGASTRATGIPARFSGSGSGTEFTLTISSLQSEDFAVYYCQYYDNWPPEFTFGPGTKVDIK

SEQ ID NO: 2418 - protein, 11 aa, Artificial Sequence
  Description of Artificial Sequence: Synthetic peptide
QYYDNWPPEFT

SEQ ID NO: 2419 - protein, 121 aa, Artificial Sequence
  Description of Artificial Sequence: Synthetic polypeptide
QVQLVQSGAEVKKPGSSVKVSCKASGGTFSSYVINWVRQAPGQGLEWMGRIMPILDVATYTQKFQGRVTITADKSTSTAYMELSSMRFDDTAVYYCARGVIAATPGYFDIWGQGTMVTVSS

SEQ ID NO: 2420 - protein, 14 aa, Artificial Sequence
  Description of Artificial Sequence: Synthetic peptide
ARGVIAATPGYFDI

SEQ ID NO: 2421 - protein, 106 aa, Artificial Sequence
  Description of Artificial Sequence: Synthetic polypeptide
EIVMTQSPATLSVSPGERATLSCRASQSISNNLAWYQQKPGQSPRLLVYGASTRATGIPARFSGSGSGTEFTLTISSLQSEDFAVYYCQQYNNGLTFGGGTKVEIK

SEQ ID NO: 2422 - protein, 8 aa, Artificial Sequence
  Description of Artificial Sequence: Synthetic peptide
QQYNNGLT

SEQ ID NO: 2423 - protein, 122 aa, Artificial Sequence
  Description of Artificial Sequence: Synthetic polypeptide
QVQLVQSGAEVKKPGASVKVSCKASGYTFTSYYIHWVRQAPGQGLEWMGIINADAGSITYAQKFQGRVTMTRDTSTSTVYMDLSSLRSEDTAVYYCARGGAIPVPRGASDYWGQGTLVTVSS

SEQ ID NO: 2424 - protein, 15 aa, Artificial Sequence
  Description of Artificial Sequence: Synthetic peptide
ARGGAIPVPRGASDY

SEQ ID NO: 2425 - protein, 107 aa, Artificial Sequence
  Description of Artificial Sequence: Synthetic polypeptide
DIQMTQSPSTLSASVGDTITITCRASQSISTWLAWFQQKPGKAPKVLIYRASSLESEVPSRFSGSGSGTEFTLTITSLQPDDFASYYCQQYNSYPWTFGQGTKVEIK

SEQ ID NO: 2426 - protein, 9 aa, Artificial Sequence
  Description of Artificial Sequence: Synthetic peptide
QQYNSYPWT

SEQ ID NO: 2427 - protein, 117 aa, Artificial Sequence
  Description of Artificial Sequence: Synthetic polypeptide
EVQLVESGGGLVQPGGSLRLSCAASEITVSSNYMTWVRQAPGKGLEWVSVMYSGGSTFYADSVKGRFTISRDNSKNTLYLQMKSLRVEDTAVYYCARDLYYYGMDVWGQGTTVTVSS

SEQ ID NO: 2428 - protein, 11 aa, Artificial Sequence
  Description of Artificial Sequence: Synthetic peptide
ARDLYYYGMDV

SEQ ID NO: 2429 - protein, 106 aa, Artificial Sequence
  Description of Artificial Sequence: Synthetic polypeptide
DIQLTQSPSFLSASVGDRVTITCRASQGISNYLAWYQQKPGKAPKLLIYAASTLQSGVPSRFSGSGSGTEFTLTISSLQPEDFATYYCQQVDSYPLFGQGTRLEIK

SEQ ID NO: 2430 - protein, 8 aa, Artificial Sequence
  Description of Artificial Sequence: Synthetic peptide
QQVDSYPL

SEQ ID NO: 2431 - protein, 122 aa, Artificial Sequence; identical to SEQ ID NO: 65
  Description of Artificial Sequence: Synthetic polypeptide

SEQ ID NO: 2432 - protein, 16 aa, Artificial Sequence
  Description of Artificial Sequence: Synthetic peptide
ARMVYDSSGFKGYFDL

SEQ ID NO: 2433 - protein, 108 aa, Artificial Sequence; identical to SEQ ID NO: 66
  Description of Artificial Sequence: Synthetic polypeptide

SEQ ID NO: 2434 - protein, 10 aa, Artificial Sequence
  Description of Artificial Sequence: Synthetic peptide
QQSYSTSMYT

SEQ ID NO: 2435 - protein, 139 aa, Artificial Sequence
  Description of Artificial Sequence: Synthetic polypeptide
QVQLVQSGAEVKKPGASVEVSCKASGNTFTNHYIHWVRQAPGQGLEWMGIINPWGASTSYAQRFQGRVTMTRDTSTTTDTSTTTVYMEMTSLISEDTAVYYCARGPPPRPIGFLESLSPEDAFGGLDVWGQGTTVTVSS

SEQ ID NO: 2436 - protein, 26 aa, Artificial Sequence
  Description of Artificial Sequence: Synthetic peptide
ARGPPPRPIGFLESLSPEDAFGGLDV

SEQ ID NO: 2437 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGGGSGTDFTFTISSLQPQDIATYYCQQYDNLPLTFGGGTKVEIK

SEQ ID NO: 2438 - protein, 9 aa, Artificial Sequence
  Description of Artificial Sequence: Synthetic peptide
QQYDNLPLT

SEQ ID NO: 2439 - protein, 120 aa, Artificial Sequence; identical to SEQ ID NO: 61
  Description of Artificial Sequence: Synthetic polypeptide

SEQ ID NO: 2440 - protein, 14 aa, Artificial Sequence
  Description of Artificial Sequence: Synthetic peptide
AAGLKGRSSSWYEY

SEQ ID NO: 2441 - protein, 107 aa, Artificial Sequence; identical to SEQ ID NO: 62
  Description of Artificial Sequence: Synthetic polypeptide

SEQ ID NO: 2442 - protein, 9 aa, Artificial Sequence
  Description of Artificial Sequence: Synthetic peptide
QQTYSSPHT

SEQ ID NO: 2443 - protein, 114 aa, Artificial Sequence
  Description of Artificial Sequence: Synthetic polypeptide
EVQLVETGGGLIQPGGSLRLSCAVSGFTVSANYMIWVRQAPGKGLEWVSMIYPGGSTFYADSVKGRFSISRDNSKDTLHLQMNSLRAEDTAVYYCARHQVGFEWGQGTLVTVSS

SEQ ID NO: 2444 - protein, 8 aa, Artificial Sequence
  Description of Artificial Sequence: Synthetic peptide
ARHQVGFE

SEQ ID NO: 2445 - protein, 107 aa, Artificial Sequence
  Description of Artificial Sequence: Synthetic polypeptide
DIQMTQSPSSLSASVGDRVTITCQASQDIRNYLNWYQQKPGKAPKVLIYDATNLEAGVPSRFSGSGSGTDFTFTISSLQPEDIATYFCHQYDNLPITFGQGTRLEIK

SEQ ID NO: 2446 - protein, 9 aa, Artificial Sequence
  Description of Artificial Sequence: Synthetic peptide
HQYDNLPIT

SEQ ID NO: 2447 - protein, 115 aa, Artificial Sequence
  Description of Artificial Sequence: Synthetic polypeptide
EVQLVESGGGLVQPGGSLRLACAASEIIVSTNYMNWVRQAPGKGLEWVSVIYSGGSTFYADSVKGRFTISRDNSKNTLYLQMNSLRVEDTAVYYCARETYGMDVWGQGTTVTVSS

SEQ ID NO: 2448 - protein, 9 aa, Artificial Sequence
  Description of Artificial Sequence: Synthetic peptide
ARETYGMDV

SEQ ID NO: 2449 - protein, 109 aa, Artificial Sequence
  Description of Artificial Sequence: Synthetic polypeptide
DIQLTQSPSFLSASVGDRVTITCRASQGISSYLAWYQQKPGKAPKLLIYSASTLQSGVPSRFSGSGSGTEFTLTISSLQPEDLATYYCQQLNSSPQKGTFGQGTKVEIK

SEQ ID NO: 2450 - protein, 11 aa, Artificial Sequence
  Description of Artificial Sequence: Synthetic peptide
QQLNSSPQKGT

SEQ ID NO: 2451 - protein, 128 aa, Artificial Sequence
  Description of Artificial Sequence: Synthetic polypeptide
EVQLVQSGAEVKKHGESLRISCKGSGYSFTNYYITWVRQMPGKGLEWMGRIDPRDSYTNYSPSFQGHVTISVDKSISTAYLQWSRLKAADTAIYYCARHGSGYLEPTNHYYYYGMDVWGQGTTVTVSS

SEQ ID NO: 2452 - protein, 21 aa, Artificial Sequence
  Description of Artificial Sequence: Synthetic peptide
ARHGSGYLEPTNHYYYYGMDV

SEQ ID NO: 2453 - protein, 105 aa, Artificial Sequence
  Description of Artificial Sequence: Synthetic polypeptide
EIVLTQSPGTLSLSPGERATLSCRASQSVSSIYLAWYQQKPGQAPRLLIYGASSRATGIPDRFSGSGSGTDFTLTISRLEPEDFAVYYCQQYGSSFGQGTKLEIK

SEQ ID NO: 2454 - protein, 6 aa, Artificial Sequence
  Description of Artificial Sequence: Synthetic peptide
QQYGSS

SEQ ID NO: 2455 - protein, 122 aa, Artificial Sequence; identical to SEQ ID NO: 71
  Description of Artificial Sequence: Synthetic polypeptide

SEQ ID NO: 2456 - protein, 15 aa, Artificial Sequence
  Description of Artificial Sequence: Synthetic peptide
AGSYSNYIGGVWFDP

SEQ ID NO: 2457 - protein, 106 aa, Artificial Sequence; identical to SEQ ID NO: 72
  Description of Artificial Sequence: Synthetic polypeptide

SEQ ID NO: 2458 - protein, 8 aa, Artificial Sequence
  Description of Artificial Sequence: Synthetic peptide
QQRNNWLT

SEQ ID NO: 2459 - protein, 121 aa, Artificial Sequence
  Description of Artificial Sequence: Synthetic polypeptide
EVQLVQSGAEVKKPGESLKISCKVSGYSFISYWIGWVRQMPGKGLEWMGIIYPYDSDTRYSPSFQGQVTISADKSINTAYLQWSSLKASDTAIYYCARHVTWGLGYFMDVWGKGTTVTVSS

SEQ ID NO: 2460 - protein, 14 aa, Artificial Sequence
  Description of Artificial Sequence: Synthetic peptide
ARHVTWGLGYFMDV

SEQ ID NO: 2461 - protein, 107 aa, Artificial Sequence
  Description of Artificial Sequence: Synthetic polypeptide
DIQMTQSPSSLSASVGDRLTITCRASHSIGSSLNWYQHKPGKAPKLLIYAASSLQSGVPSRFSGSGSGTDFTLTISSLQPEDFATYFCQQSYSTPLTVGGGTTVEIK

SEQ ID NO: 2462 - protein, 9 aa, Artificial Sequence
  Description of Artificial Sequence: Synthetic peptide
QQSYSTPLT

SEQ ID NO: 2463 - protein, 119 aa, Artificial Sequence
  Description of Artificial Sequence: Synthetic polypeptide
EVQLVESGGGLIQPGGSLRLSCAAPGLIVSRNYMSWVRQAPGKGLEWVSIIYPGGSSYYADSVKGRFTISRDSSKNTLFLQMNFLRADDTAVYYCVRPMVRGIRDMDVWGKGTSVTVSS

SEQ ID NO: 2464 - protein, 13 aa, Artificial Sequence
  Description of Artificial Sequence: Synthetic peptide
VRPMVRGIRDMDV

SEQ ID NO: 2465 - protein, 107 aa, Artificial Sequence
  Description of Artificial Sequence: Synthetic polypeptide
DIQMTQSPSSLSASVGDRVTITCQATQDINTYLNWYQQKPGKAPKLLIYDASNLETGVPSRFSGSGSGTDFTFTISSLQPEDIATYYCHQYDNLPLTFGGGTKVEIK

SEQ ID NO: 2466 - protein, 9 aa, Artificial Sequence
  Description of Artificial Sequence: Synthetic peptide
HQYDNLPLT

SEQ ID NO: 2467 - protein, 116 aa, Artificial Sequence; identical to SEQ ID NO: 81
  Description of Artificial Sequence: Synthetic polypeptide

SEQ ID NO: 2468 - protein, 10 aa, Artificial Sequence
  Description of Artificial Sequence: Synthetic peptide
ARDLAGRLDY

SEQ ID NO: 2469 - protein, 108 aa, Artificial Sequence; identical to SEQ ID NO: 82
  Description of Artificial Sequence: Synthetic polypeptide

SEQ ID NO: 2470 - protein, 10 aa, Artificial Sequence
  Description of Artificial Sequence: Synthetic peptide
QQYDSLSRLT

SEQ ID NO: 2471 - protein, 117 aa, Artificial Sequence
  Description of Artificial Sequence: Synthetic polypeptide
EVQLVESGGGLVQPGGSLRLSCAGSGFTVSSNYMNWVRQAPGKGLEWVSTIYSGGSSFYADSVKGRFTISRDNSKNTLYLQMDSLRGEDTAVYYCARDKLQRGGPDWGQGTLVTVSS

SEQ ID NO: 2472 - protein, 11 aa, Artificial Sequence
  Description of Artificial Sequence: Synthetic peptide
ARDKLQRGGPD

SEQ ID NO: 2473 - protein, 107 aa, Artificial Sequence
  Description of Artificial Sequence: Synthetic polypeptide
DIQMTQSPSSLSASVGDRVTITCQASQDTNNYLNWYQQKPGKAPKLLIYDASNLETGVPSRFSGSRSGTDFTFTISSLQPEDIATYYCHQYDNLPQTFGQGTKLEIK

SEQ ID NO: 2474 - protein, 9 aa, Artificial Sequence
  Description of Artificial Sequence: Synthetic peptide
HQYDNLPQT

SEQ ID NO: 2475 - protein, 125 aa, Artificial Sequence
  Description of Artificial Sequence: Synthetic polypeptide
QVQLVQSGAEVKKPGASVKVSCKSSGYTFTSYAISWIRQAPGQGLEWLGWINTFNGDTNFPQKLQGRVTMTTDTSTSTAYMELRSLRSDDTAMYYCARVGDYYYGSGTTYYFDYWGQGTLVTVSS

SEQ ID NO: 2476 - protein, 18 aa, Artificial Sequence
  Description of Artificial Sequence: Synthetic peptide
ARVGDYYYGSGTTYYFDY

SEQ ID NO: 2477 - protein, 105 aa, Artificial Sequence
  Description of Artificial Sequence: Synthetic polypeptide
DIQMTQSPSSVSASVGDRVTITCRASQGISTSLAWYQQKPGKAPKLLTSLQSGVPSRFSGSGSGTDFTLTISSLQPEDFATYYCQQADNFPPLFTFGPGTKVEIK

SEQ ID NO: 2478 - protein, 11 aa, Artificial Sequence
  Description of Artificial Sequence: Synthetic peptide
QQADNFPPLFT

SEQ ID NO: 2479 - protein, 123 aa, Artificial Sequence
  Description of Artificial Sequence: Synthetic polypeptide
EVQLVESGGDLVQPGGSLRLSCAASGFSFSTYNMNWVRQAPGKGLEWVLYISSSSDTIYYADSVKGRFTISRDNAKNSLYLQMNSLRAEDTAVYYCARHSGSSSYYYYGMDVWGQGTTVTVSS

SEQ ID NO: 2480 - protein, 16 aa, Artificial Sequence
  Description of Artificial Sequence: Synthetic peptide
ARHSGSSSYYYYGMDV

SEQ ID NO: 2481 - protein, 107 aa, Artificial Sequence
  Description of Artificial Sequence: Synthetic polypeptide
DIQMTQSPSSLSASVGDRVTITCRASQNIYSYLNWYQQKPGKAPKLLIYGVSSLQSGVPSTFSGSGSGTDFTLTISSLQPEDFATYYCQQSYSTPPTFGGGTKVDIK

SEQ ID NO: 2482 - protein, 9 aa, Artificial Sequence
  Description of Artificial Sequence: Synthetic peptide
QQSYSTPPT

SEQ ID NO: 2483 - protein, 116 aa, Artificial Sequence
  Description of Artificial Sequence: Synthetic polypeptide
EVQLVESGGGLVQPGGSLRLSCAASGFTLSHNYMSWVRQAPGKGLEWVSVIYSGGRTYYADSVKDRFTISRDNSKNTLYLQMNSLRAEDTAVYYCARDLSDGEGPWGQGTLVTVSS

SEQ ID NO: 2484 - protein, 10 aa, Artificial Sequence
  Description of Artificial Sequence: Synthetic peptide
ARDLSDGEGP

SEQ ID NO: 2485 - protein, 107 aa, Artificial Sequence
  Description of Artificial Sequence: Synthetic polypeptide
AIQMTQSPSSLSASVGDRVTITCRASQDIRHALGWFHQKPGEAPKLLIYAASNLQSGVPPRFSGSGSGTDFTLTISSLQPEDFATYYCLQDYNYPRTFGQGTRVEIK

SEQ ID NO: 2486 - protein, 9 aa, Artificial Sequence
  Description of Artificial Sequence: Synthetic peptide
LQDYNYPRT

SEQ ID NO: 2487 - protein, 126 aa, Artificial Sequence
  Description of Artificial Sequence: Synthetic polypeptide
EVQLVESGGGLVQPGESLKLSCSASGFTFNNYGMHWVRQAPGKGLEYLSSISSDGGSTTYADSVKGRFTISRDNSKNTLYFQMSSLRTEDTAVYYCVKGDIPYCSGDCYGNAFDIWGQGTMVTVSS

SEQ ID NO: 2488 - protein, 19 aa, Artificial Sequence
  Description of Artificial Sequence: Synthetic peptide
VKGDIPYCSGDCYGNAFDI

SEQ ID NO: 2489 - protein, 109 aa, Artificial Sequence
  Description of Artificial Sequence: Synthetic polypeptide
DIQMTQSPSSLSTSVGDRVTITCQASQDISNSLNWYQQRPGKAPKLLIYDASNLETGVPSRFSGSGSGTYFTFTISSLQPEDIATYYCQQYDNLPPGYTFGQGTKLEIK

SEQ ID NO: 2490 - protein, 11 aa, Artificial Sequence
  Description of Artificial Sequence: Synthetic peptide
QQYDNLPPGYT

SEQ ID NO: 2491 - protein, 120 aa, Artificial Sequence
  Description of Artificial Sequence: Synthetic polypeptide
QVQLVESGGGVVQPGRSLRLSCAASGFTFTTYGMHWLRQVPGKGLEWVAVIWYDGSNQYYADSVKGRFTISRDNSKNTLYLQMNSLRAEDTAVYYCARDIGIVVVEIDYWGQGTLVTVSS

SEQ ID NO: 2492 - protein, 13 aa, Artificial Sequence
  Description of Artificial Sequence: Synthetic peptide
ARDIGIVVVEIDY

SEQ ID NO: 2493 - protein, 112 aa, Artificial Sequence
  Description of Artificial Sequence: Synthetic polypeptide
  MOD_RES (92)..(92): Any amino acid
DVVMTQSPLSLPVTLGQPASISCRSSQSLVYIDENTYLHWFQQRPGQSPRRLIYKVSNRDSGVPDRFSGSGSGTDFTLKISRVEAEDVGVYXCMQGTHWPYTFGQGTKLEIK

SEQ ID NO: 2494 - protein, 9 aa, Artificial Sequence
  Description of Artificial Sequence: Synthetic peptide
MQGTHWPYT

SEQ ID NO: 2495 - protein, 123 aa, Artificial Sequence
  Description of Artificial Sequence: Synthetic polypeptide
QMQLVQSGPEVKKPGTSVKVSCKASGFTFSSSAVQWVRQARGQRLEWIGWIVVGSGNTNYAQKFQERVTITRDMSTSTAYMELSSLRSEDTAVFYCAAPYCNVTTCFDGFNIWGRGTMVTVSS

SEQ ID NO: 2496 - protein, 16 aa, Artificial Sequence
  Description of Artificial Sequence: Synthetic peptide
AAPYCNVTTCFDGFNI

SEQ ID NO: 2497 - protein, 108 aa, Artificial Sequence; identical to SEQ ID NO: 92
  Description of Artificial Sequence: Synthetic polypeptide

SEQ ID NO: 2498 - protein, 9 aa, Artificial Sequence
  Description of Artificial Sequence: Synthetic peptide
QQYGSSPWT

SEQ ID NO: 2499 - protein, 117 aa, Artificial Sequence
  Description of Artificial Sequence: Synthetic polypeptide
EVQLVESGGGLVQPGGSLRLSCAATEITVSSNYMTWVRQAPGKGLEWVSVIYPGGSTFYADSVKGRFSISRDNSKNTLYLQMNSLRAEDTAVYYCARDLVVYGLDCWGQGTLVTVSS

SEQ ID NO: 2500 - protein, 11 aa, Artificial Sequence
  Description of Artificial Sequence: Synthetic peptide
ARDLVVYGLDC

SEQ ID NO: 2501 - protein, 107 aa, Artificial Sequence; identical to SEQ ID NO: 76
  Description of Artificial Sequence: Synthetic polypeptide

SEQ ID NO: 2502 - protein, 9 aa, Artificial Sequence
  Description of Artificial Sequence: Synthetic peptide
QQLNTYPPP

SEQ ID NO: 2503 - protein, 117 aa, Artificial Sequence
  Description of Artificial Sequence: Synthetic polypeptide
EVQLVESGGGLVQPGGSLRLSCAASGIVVSSNYMSWVRQAPGKGLEWVSLLYSGGSTFYADSVKGRFTISRDNSKNTLYLQMNSLRADDTAVYYCARDLVVRGLDVWGQGTTVTVSS

SEQ ID NO: 2504 - protein, 11 aa, Artificial Sequence
  Description of Artificial Sequence: Synthetic peptide
ARDLVVRGLDV

SEQ ID NO: 2505 - protein, 107 aa, Artificial Sequence
  Description of Artificial Sequence: Synthetic polypeptide
DIQLTQSPSFLSASVGDRVTITCRASQGISSDLAWYQQKPGKAPKLLIYAASTLQSGVPSRFSGSGSETEFTLTISSLQPEDFATYYCQQLNSDLCAFGQGTRLEIK

SEQ ID NO: 2506 - protein, 9 aa, Artificial Sequence
  Description of Artificial Sequence: Synthetic peptide
QQLNSDLCA

SEQ ID NO: 2507 - protein, 122 aa, Artificial Sequence
  Description of Artificial Sequence: Synthetic polypeptide
QVQLVQSGAEVRKPGSSVKVSCKASGGPFDQYTFSWVRQAPGQGLEWMARITPVVDLTNYAQKFQGRITIITDKSTSTAYMELSSLRSEDTAIYYCATPLNDYYASGNLGLWGQGTRVTVSS

SEQ ID NO: 2508 - protein, 15 aa, Artificial Sequence
  Description of Artificial Sequence: Synthetic peptide
ATPLNDYYASGNLGL

SEQ ID NO: 2509 - protein, 107 aa, Artificial Sequence
  Description of Artificial Sequence: Synthetic polypeptide
DIQMTQSPSSLSASIGDRVTITCRASQGISYYLAWFQQKPGEAPRSLIYDASSLQSGVPSKFSGSGSGTDFTLTISSLQPEDSATYYCQQYNSYPLTFGGGTKLEIK

SEQ ID NO: 2510 - protein, 9 aa, Artificial Sequence
  Description of Artificial Sequence: Synthetic peptide
QQYNSYPLT

SEQ ID NO: 2511 - protein, 119 aa, Artificial Sequence
  Description of Artificial Sequence: Synthetic polypeptide
EVQLVQSGAEVKKPGESLKISCKGSGDSFPSYWIGWVRQMPGKGLEWMGIIYPDDSETIYSPSFQGQVTISTDKSISTAYLQWSSLKASDTAIYYCARRGYHYYGMDVWGQGTTVTVSS

SEQ ID NO: 2512 - protein, 12 aa, Artificial Sequence
  Description of Artificial Sequence: Synthetic peptide
ARRGYHYYGMDV

SEQ ID NO: 2513 - protein, 106 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTITSLQPDDFATYYCQQYNSYLGTFGQGTKVEI

SEQ ID NO: 2514 - protein, 9 aa, Artificial Sequence
  Description of Artificial Sequence: Synthetic peptide
QQYNSYLGT

SEQ ID NO: 2515 - protein, 120 aa, Artificial Sequence
  Description of Artificial Sequence: Synthetic polypeptide
EVQLVQSGAEVKKPGESLRISCKASGYNFPSYWISWVRQMPGKGLEWMGRIDPSDSSTNYSPSFQGHVTVSVDKSITTAYLQWSSLKASDTAMYFCARTGGGYYNWFDPWGQGTLVTVSS

SEQ ID NO: 2516 - protein, 13 aa, Artificial Sequence
  Description of Artificial Sequence: Synthetic peptide
ARTGGGYYNWFDP

SEQ ID NO: 2517 - protein, 107 aa, Artificial Sequence
  Description of Artificial Sequence: Synthetic polypeptide
DIQMTQSPSSLSASVGDRVTITCRASQNIGSYLNWYQQTPGKVPKLLIYAASTLHSGVPSRFSGSESGTHFTLTISSLQPEDFATYFCQQSYSSPPTFGQGTKVEIK

SEQ ID NO: 2518 - protein, 9 aa, Artificial Sequence
  Description of Artificial Sequence: Synthetic peptide
QQSYSSPPT

SEQ ID NO: 2519 - protein, 121 aa, Artificial Sequence
  Description of Artificial Sequence: Synthetic polypeptide
QVQLVQSGAEVKKPGASVKVSCKASGFSFTIYYIHWVRQAPGQGLEWMGIINPDAGSIGYAQNFQGRVTMTRDTSTSTVYMELTSLRSEDTAVYFCARGALLPAADAFDIWGQGTMVTVSS

SEQ ID NO: 2520 - protein, 14 aa, Artificial Sequence
  Description of Artificial Sequence: Synthetic peptide
ARGALLPAADAFDI

SEQ ID NO: 2521 - protein, 109 aa, Artificial Sequence
  Description of Artificial Sequence: Synthetic polypeptide
EIVMTQSPATLSVSPGERATLSCRASQGVSSNLAWYQQKPGQAPRLLIYGASTRATGIPARFSGSGSGTEFTLTISSLQSEDSAVYYCQQYSNWPPLYTFGQGTKLEIK

SEQ ID NO: 2522 - protein, 11 aa, Artificial Sequence
  Description of Artificial Sequence: Synthetic peptide
QQYSNWPPLYT

SEQ ID NO: 2523 - protein, 123 aa, Artificial Sequence
  Description of Artificial Sequence: Synthetic polypeptide
QMQLVQSGPEVKKPGTSVKVSCKASGFTFGSSAVQWVRQARGQRLEWIGWIVVGSGNTDYAQRFQERVTITRDMSTNTVYMELSSLRFEDTAVYYCAAVYCSGTTCHDAFDIWGRGTMVTASS

SEQ ID NO: 2524 - protein, 16 aa, Artificial Sequence
  Description of Artificial Sequence: Synthetic peptide
AAVYCSGTTCHDAFDI

SEQ ID NO: 2525 - protein, 114 aa, Artificial Sequence
  Description of Artificial Sequence: Synthetic polypeptide
  MOD_RES (12)..(12): Any amino acid
DIQMTQSPSSLXASVGDRVTITCQATQDIRKYLNWFRRKLEKAPKLLIYDASTLDTRVPSRFSGNRSATDFTFTICSLQPEDNARYSCQQSDTLPPLGGDTPDTFGHGTKLEIK

SEQ ID NO: 2526 - protein, 16 aa, Artificial Sequence
  Description of Artificial Sequence: Synthetic peptide
QQSDTLPPLGGDTPDT

SEQ ID NO: 2527 - protein, 122 aa, Artificial Sequence
  Description of Artificial Sequence: Synthetic polypeptide
QVQLVQSGAEVKKPGASVKVSCKASGNTFMTYYIHWVRQAPGQGPEWMGIMNPSGGSTTYAQKFQGRLTMTRDTSKSTVYLELSSLRSEDTAVYFCARGGIVPDASEPFDIWGQGTMVTVSS

SEQ ID NO: 2528 - protein, 15 aa, Artificial Sequence
  Description of Artificial Sequence: Synthetic peptide
ARGGIVPDASEPFDI

SEQ ID NO: 2529 - protein, 108 aa, Artificial Sequence
  Description of Artificial Sequence: Synthetic polypeptide
DIQMTQSPSTLSASVGDRVTITCRASQSISAWLAWYQQKPGKAPKLLIYKASSLESGVPSRFSGSGSGTDFTLTISSLQPDDFATYYCQHYKSDSPYTFGQGTKLEIK

SEQ ID NO: 2530 - protein, 10 aa, Artificial Sequence
  Description of Artificial Sequence: Synthetic peptide
QHYKSDSPYT

SEQ ID NO: 2531 - protein, 122 aa, Artificial Sequence
  Description of Artificial Sequence: Synthetic polypeptide
QVQLVQSGAEVKKPGASVKVSCKASRNTFTNYYIHWVRQAPGQGLEWLGIINPDAGSTTYAQKFQGSVIMTRDTSTSTVYMELASLRSEDTAVYYCARDFAGIPATSYFEYWGQGTLVTVSS

SEQ ID NO: 2532 - protein, 15 aa, Artificial Sequence
  Description of Artificial Sequence: Synthetic peptide
ARDFAGIPATSYFEY

SEQ ID NO: 2533 - protein, 109 aa, Artificial Sequence
  Description of Artificial Sequence: Synthetic polypeptide
EIVLTQSPATLSLSPGERATLSCRASQSVSNYLAWYQQKPGQAPRLLIYDASNRATGIPARFSGSGSGTDFTLTISSLEPEDFAIYYCQHRTNWPPMYTFGQGTKLEIK

SEQ ID NO: 2534 - protein, 11 aa, Artificial Sequence
  Description of Artificial Sequence: Synthetic peptide
QHRTNWPPMYT

SEQ ID NO: 2535 - protein, 117 aa, Artificial Sequence
  Description of Artificial Sequence: Synthetic polypeptide
EVQLVESGGGLVQPGGSLRLSCEASGITVSSNYMIWVRQAPGKGLEWVSVIYSGGSTFYADSVKGRFTISRDDSRNTLFLQMSSLRAEDTAVYYCARDLVVYGADYWGQGTLVTVSS

SEQ ID NO: 2536 - protein, 11 aa, Artificial Sequence
  Description of Artificial Sequence: Synthetic peptide
ARDLVVYGADY

SEQ ID NO: 2537 - protein, 107 aa, Artificial Sequence
  Description of Artificial Sequence: Synthetic polypeptide
DIQLTQSPSFLSASVGDRVTITCRASQGISNYLAWYQQKPGKAPKLLIYTASTLQNGVPSRFSGSGSGTEFTLTISSLQPEDFATYYCQQLDTYPPPFGGGTKVEIK

SEQ ID NO: 2538 - protein, 9 aa, Artificial Sequence
  Description of Artificial Sequence: Synthetic peptide
QQLDTYPPP

SEQ ID NO: 2539 - protein, 126 aa, Artificial Sequence
  Description of Artificial Sequence: Synthetic polypeptide
QVQLVQSGAEVKKPGSSVKVSCKASGGTFNNYAIGWVRQAPGQGLEWMGTTIPIFGAANSPQKFQGRVTITADESMSTVYMELSSLRSEDTALYYCARAALYCSGGSCYRYYFDYWGQGTLVTVSS

SEQ ID NO: 2540 - protein, 19 aa, Artificial Sequence
  Description of Artificial Sequence: Synthetic peptide
ARAALYCSGGSCYRYYFDY

SEQ ID NO: 2541 - protein, 106 aa, Artificial Sequence
  Description of Artificial Sequence: Synthetic polypeptide
DIQMTQSPSTLSASVGDRVTITCRASQSISGWLAWYQQKPGKAPKLLIYKASTLQTGVPSRFSGSGSETEFTLTISSLQPDDFATYYCQQYNTYSTFGPGTKVEIE

SEQ ID NO: 2542 - protein, 8 aa, Artificial Sequence
  Description of Artificial Sequence: Synthetic peptide
QQYNTYST

SEQ ID NO: 2543 - protein, 123 aa, Artificial Sequence
  Description of Artificial Sequence: Synthetic polypeptide
EVQLVQSGAEVKKPGESLTISCKGSGYSFTNYWIGWVRQLPGKGLEWMAIFYPGDSDTRFSPSFQGQVTMSADKSTSTAYLQWSSLKASDTAMYYCARPRHNSTWYYGAFDIWGQGTMVTVSS

SEQ ID NO: 2544 - protein, 16 aa, Artificial Sequence
  Description of Artificial Sequence: Synthetic peptide
ARPRHNSTWYYGAFDI

SEQ ID NO: 2545 - protein, 113 aa, Artificial Sequence
  Description of Artificial Sequence: Synthetic polypeptide
DIVMTQSPLSLSVTPGEPASISCRSSQSLFRSYGYNYLDWYLQKPGQSPQLLIYLGSNRASGVPDRFSGSGSGTDFTLKISRVEAEDVGVYYCMQSLQTPPNTFGPGTKVDIK

SEQ ID NO: 2546 - protein, 10 aa, Artificial Sequence
  Description of Artificial Sequence: Synthetic peptide
MQSLQTPPNT

SEQ ID NO: 2547 - protein, 127 aa, Artificial Sequence
  Description of Artificial Sequence: Synthetic polypeptide
QVQLVESGGGVVQPGRSLRLSCAASGFTFNNYVMHWVRQAPDKGLEWVAGILYDGSDKNYADSVKGRFTISRDNSKNTLYLQMNSLRAEDTAVYYCAKQAGMYCSGGNCFLSYFDYWGQGALVTVSS

SEQ ID NO: 2548 - protein, 20 aa, Artificial Sequence
  Description of Artificial Sequence: Synthetic peptide
AKQAGMYCSGGNCFLSYFDY

SEQ ID NO: 2549 - protein, 107 aa, Artificial Sequence
  Description of Artificial Sequence: Synthetic polypeptide
DIQMTQSPSSLSASVGDRVTITCQASQDIKNNLNWYQQKPGKAPKLQIYDASNLETGVPSRFSGSGSGTDFTFTISSLQAEDTATYYCQQYENLPPTFGQGTRVEIK

SEQ ID NO: 2550 - protein, 9 aa, Artificial Sequence
  Description of Artificial Sequence: Synthetic peptide
QQYENLPPT

SEQ ID NO: 2551 - protein, 116 aa, Artificial Sequence
  Description of Artificial Sequence: Synthetic polypeptide
EVQLVESGGGLIQPGGSLRLSCAASGITVSRNYMSWVRQAPGKGLEWVSVIYPGGSTFHADSVKGRFTISRDNSKNMLYLQMNSLRAEDTAVYYCARVLYDAFDIWGQGTMVTVSS

SEQ ID NO: 2552 - protein, 10 aa, Artificial Sequence
  Description of Artificial Sequence: Synthetic peptide
ARVLYDAFDI

SEQ ID NO: 2553 - protein, 108 aa, Artificial Sequence
  Description of Artificial Sequence: Synthetic polypeptide
DIQLTQSPSFLSASVGDRVTITCRASQGISSYLAWYQQKPGKAPKLLIYSASTLQSGVPSRFSGSGSGTEFTLTISSLQPEDFATYYCQQLNSYPPCTFGPGTKVDIK

SEQ ID NO: 2554 - protein, 10 aa, Artificial Sequence
  Description of Artificial Sequence: Synthetic peptide
QQLNSYPPCT

SEQ ID NO: 2555 - protein, 117 aa, Artificial Sequence
  Description of Artificial Sequence: Synthetic polypeptide
EVQLVESGGGLVQPGGSLRLSCAASEITVSSNYMSWVRQAPGKGLEWVSLIYSGGSTYYADSVKGRFTISRDNSKNTLYLQMNSLRADDTAVYYCARDPPSRRGSCWGQGTLVTVSS

SEQ ID NO: 2556 - protein, 11 aa, Artificial Sequence
  Description of Artificial Sequence: Synthetic peptide
ARDPPSRRGSC

SEQ ID NO: 2557 - protein, 107 aa, Artificial Sequence; identical to SEQ ID NO: 1009
  Description of Artificial Sequence: Synthetic polypeptide

SEQ ID NO: 2558 - protein, 9 aa, Artificial Sequence
  Description of Artificial Sequence: Synthetic peptide
QQYDNLPIT

SEQ ID NO: 2559 - protein, 115 aa, Artificial Sequence
  Description of Artificial Sequence: Synthetic polypeptide
EVQLVETGGGLIQPGGSLRLSCAASDLTVSSNYMNWVRQAPGKRLEWVSVIYPGGSTFYADSVKGRFTISRDNSKNTLYLQMNSLRAEDTAIYYCAREAYGMDVWGQGTTVTVSS

SEQ ID NO: 2560 - protein, 9 aa, Artificial Sequence
  Description of Artificial Sequence: Synthetic peptide
AREAYGMDV

SEQ ID NO: 2561 - protein, 107 aa, Artificial Sequence
  Description of Artificial Sequence: Synthetic polypeptide
EIVLTQSPGTLSLSPGERATLSCRASQSVASSYLAWYQQKPGQAPRLLIYGASSRAAGIPDRFSGSGSGTDFTLTISRLEPEDFAVYYCQQYGSSYTFGQGTKLEIK

SEQ ID NO: 2562 - protein, 8 aa, Artificial Sequence
  Description of Artificial Sequence: Synthetic peptide
QQYGSSYT

SEQ ID NO: 2563 - protein, 119 aa, Artificial Sequence
  Description of Artificial Sequence: Synthetic polypeptide
QVQLQESGPRLVKPAQTLSLTCTVSGVSISYGGYYWSWIRQHPGKGLEWIGNVYYSGSTYYNPSLKSRLSISVDTSKNQFSLNLNSVTAADTAVYYCARVNAHSHFDYWGQGTLVTVSS

SEQ ID NO: 2564 - protein, 11 aa, Artificial Sequence
  Description of Artificial Sequence: Synthetic peptide
ARVNAHSHFDY

SEQ ID NO: 2565 - protein, 108 aa, Artificial Sequence
  Description of Artificial Sequence: Synthetic polypeptide
DIQMTQSPSSLSVSVGDRVTITCQASQDFGNSLHWYQQQPGKAPKLLIYDVSNLETGVPSRFSGSGSGTDFALTINGLQPEDIATYYCQHSDNFFRYTFGQGTKLEIK

SEQ ID NO: 2566 - protein, 10 aa, Artificial Sequence
  Description of Artificial Sequence: Synthetic peptide
QHSDNFFRYT

SEQ ID NO: 2567 - protein, 124 aa, Artificial Sequence
  Description of Artificial Sequence: Synthetic polypeptide
QVQLVQSGAEVKKPGSSVKVSCEASGDTFTRYSINWIRQTPGQGLEWMGRIIPLFPLANYAQKFQGRVTITADKSTSTAYMELSNLRSEDTAMYYCACSMSPVLGAPSNWFDPWGQGTLVTVSS

SEQ ID NO: 2568 - protein, 17 aa, Artificial Sequence
  Description of Artificial Sequence: Synthetic peptide
ACSMSPVLGAPSNWFDP

SEQ ID NO: 2569 - protein, 108 aa, Artificial Sequence
  Description of Artificial Sequence: Synthetic polypeptide
EIVLTQSPGTLSLSPGERATLSCRASQSVSSSYLAWYRQKPGQAPRLLIYGATSRATGIPDRFSGSGSGTDFTLTISRLEPEDFAVYYCQHYHSSPWAFGQGTKVEVK

SEQ ID NO: 2570 - protein, 9 aa, Artificial Sequence
  Description of Artificial Sequence: Synthetic peptide
QHYHSSPWA

SEQ ID NO: 2571 - protein, 127 aa, Artificial Sequence
  Description of Artificial Sequence: Synthetic polypeptide
QVQLVESGGGVVQPGRSLRLSCAASGFAFSTYGMHWVRQAPGKGLEWVAIISYDGSHTFYGDSVKGRFTISRDNSKKTLYLQMNSLRVEDTAVYYCAKQLGPYCSGGNCYVGYFDYWGQGTRVTVSS

SEQ ID NO: 2572 - protein, 20 aa, Artificial Sequence
  Description of Artificial Sequence: Synthetic peptide
AKQLGPYCSGGNCYVGYFDY

SEQ ID NO: 2573 - protein, 107 aa, Artificial Sequence
  Description of Artificial Sequence: Synthetic polypeptide
DIQMTQSPSSLSASVGDRVTITCQASQDITNYLIWYQQKPGKAPKLLIYDASNLEAGVPSRFSGRGSGTDFTFTISSLRPEDIATYYCQQYDNLPITFGQGTKLEIK

SEQ ID NO: 2574 - protein, 9 aa, Artificial Sequence
  Description of Artificial Sequence: Synthetic peptide
QQYDNLPIT

SEQ ID NO: 2575 - protein, 120 aa, Artificial Sequence
  Description of Artificial Sequence: Synthetic polypeptide
QVQLQESGPGLVKPSETLSLTCTVSGDSISGYYCSWIRQPPGKGLEWIGYIYSTGSTRYNPSLKSRVTISVDTSKNQFSLKLSSVTAADTAMYYCAREGHDFGSGYFEYWGQGTLVPVSS

SEQ ID NO: 2576 - protein, 14 aa, Artificial Sequence
  Description of Artificial Sequence: Synthetic peptide
AREGHDFGSGYFEY

SEQ ID NO: 2577 - protein, 108 aa, Artificial Sequence
  Description of Artificial Sequence: Synthetic polypeptide
EIVLTQSPGTLSLSPGERATLSCRASHSVSSFYVAWYQQKPGQAPRLLIYGASRRATGIPDRFSGSGSGTDFTLTISRLDPEDFAVYYCQQYGGSLVTFGQGTKLEIK

SEQ ID NO: 2578 - protein, 9 aa, Artificial Sequence
  Description of Artificial Sequence: Synthetic peptide
QQYGGSLVT

SEQ ID NO: 2579 - protein, 125 aa, Artificial Sequence
  Description of Artificial Sequence: Synthetic polypeptide
QVQLQESGPGLVKPSETLSLTCTASGGSISGSYWSWIRQPPGKSLEWIGNIDYSGGTDYNASLRSRLTMSVDTSKNQFNLKLTSVTAADTAVYFCARVVYYDSRGNYYQYYFDLWGRGTLVTVSS

SEQ ID NO: 2580 - protein, 19 aa, Artificial Sequence
  Description of Artificial Sequence: Synthetic peptide
ARVVYYDSRGNYYQYYFDL

SEQ ID NO: 2581 - protein, 108 aa, Artificial Sequence
  Description of Artificial Sequence: Synthetic polypeptide
EIVLTQSPGTLSLSPGERTTLSCRASLSVSSGYLAWYQHKPGQAPRLLIYGASSRATGIPDRFSGSGSGTDFTLTISRLEPEDFAVYYCQQYGGSPFTFGPGTKVDIK

SEQ ID NO: 2582 - protein, 9 aa, Artificial Sequence
  Description of Artificial Sequence: Synthetic peptide
QQYGGSPFT

SEQ ID NO: 2583 - protein, 120 aa, Artificial Sequence
  Description of Artificial Sequence: Synthetic polypeptide
EVQLLESGGGLVQPGGSLRLSCEASGFSFSSYAMSWVRQAPGKGLEWVSGISGSGDAPNHADSVKGRFTISRDNSKNTLYLRMNSLRVEDTAVYFCAKLPTGRGGGVDYWGQGTLVTVSS

SEQ ID NO: 2584 - protein, 13 aa, Artificial Sequence
  Description of Artificial Sequence: Synthetic peptide
AKLPTGRGGGVDY

SEQ ID NO: 2585 - protein, 106 aa, Artificial Sequence
  Description of Artificial Sequence: Synthetic polypeptide
DIQMTQSPSSLSASVGDRVTITCRASLSINNYLNWYQQKPGRAPKLLIYAASSLQRGVPPRFSGSGSGTDFTLTISSLQPEDIAIYYCQQSYSWWTFGGGTKVEIK

SEQ ID NO: 2586 - protein, 8 aa, Artificial Sequence
  Description of Artificial Sequence: Synthetic peptide
QQSYSWWT

SEQ ID NO: 2587 - protein, 125 aa, Artificial Sequence
  Description of Artificial Sequence: Synthetic polypeptide
QVQLVESGGGVVQPGRSLRVSCAASGFTFSSYGMHWVRQAPGKGLEWVAFIWYDGTNKYYADSVKGRFTISRDNSKNTLYLQMNSLRAEDTAMYYCARVQGIDYGDYSWWGLDPWGQGTLVTVSS

SEQ ID NO: 2588 - protein, 18 aa, Artificial Sequence
  Description of Artificial Sequence: Synthetic peptide
ARVQGIDYGDYSWWGLDP

SEQ ID NO: 2589 - protein, 107 aa, Artificial Sequence
  Description of Artificial Sequence: Synthetic polypeptide
DIQLTQSPSFLSASVGDRVTITCRASQGISSYLAWYQQKPGKAPKLLISDASTLQSGVPSRFSGSGSGAEFTLTISSLQPEDFATYYCQQLNSYPFTFGQGTKLEIK

SEQ ID NO: 2590 - protein, 9 aa, Artificial Sequence
  Description of Artificial Sequence: Synthetic peptide
QQLNSYPFT

SEQ ID NO: 2591 - protein, 121 aa, Artificial Sequence
  Description of Artificial Sequence: Synthetic polypeptide
QVQLVQSGAEVKKPGSSVKVSCKASGDTFSSHAINWVRQAPGQGLEWMGRSIPMLGVTTSAQKFKGRVTITADHSTSTVFMDLSSLRSDDTAIYYCARGVVGATPGSFDLWGQGTVVTVSS

SEQ ID NO: 2592 - protein, 14 aa, Artificial Sequence
  Description of Artificial Sequence: Synthetic peptide
ARGVVGATPGSFDL

SEQ ID NO: 2593 - protein, 106 aa, Artificial Sequence
  Description of Artificial Sequence: Synthetic polypeptide
EIVMTQSPATLSVSPGKRATLSCRASQSVRSNLAWYQQRPGQAPRLLIYDAATRATGIPTRFSGSGSGTEFTLTISSLQSEDFAVYYCQQYDNGLTFGGGTNVEIK

SEQ ID NO: 2594 - protein, 8 aa, Artificial Sequence
  Description of Artificial Sequence: Synthetic peptide
QQYDNGLT

SEQ ID NO: 2595 - protein, 122 aa, Artificial Sequence
  Description of Artificial Sequence: Synthetic polypeptide
QVQLVESGGGVVQPGRSLRLSCAASGFTFSNYDMHWVRQAPGKGLEWVAVISSDGSSKFYGEPVKGRFTISRDNSKNTVYLQMNSLRAEDTAVYYCAKDPGESSWVDYFEYWGQGTLVTVSS

SEQ ID NO: 2596 - protein, 15 aa, Artificial Sequence
  Description of Artificial Sequence: Synthetic peptide
AKDPGESSWVDYFEY

SEQ ID NO: 2597 - protein, 108 aa, Artificial Sequence
  Description of Artificial Sequence: Synthetic polypeptide
DIQMTQSPSSLSASVGDRVTIACRASQNINNFLNWYQQKPGKAPKLLLYATSRLQSGVPSRFSGSGSGTHFTLTITSLQPEDFATYYCQQSYSNPGLTFGGGTKVDLK

SEQ ID NO: 2598 - protein, 10 aa, Artificial Sequence
  Description of Artificial Sequence: Synthetic peptide
QQSYSNPGLT

SEQ ID NO: 2599 - protein, 122 aa, Artificial Sequence
  Description of Artificial Sequence: Synthetic polypeptide
QVQLVQSGAEVKKPGASLKVSCKASGHTFSNYYIHWVRQAPGQGLEWMGIINPSGGSTSYAQKFQGRVTMTSDTSTSTVYMELSSLRTEDTAVYYCARGGLVPAANEVFDIWGQGTMVTVSS

SEQ ID NO: 2600 - protein, 15 aa, Artificial Sequence
  Description of Artificial Sequence: Synthetic peptide
ARGGLVPAANEVFDI

SEQ ID NO: 2601 - protein, 108 aa, Artificial Sequence
  Description of Artificial Sequence: Synthetic polypeptide
DIQMTQSPSTLSASVGDRVTITCRASQSISSWLAWYQQKPGNAPQLLIYKASTLESGVPSRFSGSGSGTEFTLTISSLQPDDFATYYCQHYNIYSPFTFGPGTKVDIK

SEQ ID NO: 2602 - protein, 10 aa, Artificial Sequence
  Description of Artificial Sequence: Synthetic peptide
QHYNIYSPFT

SEQ ID NO: 2603 - protein, 128 aa, Artificial Sequence
  Description of Artificial Sequence: Synthetic polypeptide
QVQLVESGGDIVQPGRSLRLSCATSGFSINDYGMHWVRQAPGKGLEWVAVIEYDGSNKYYADSVKGRFTISRDDSKNTLNLQMNSLRAEDTAVYYCARRGGLWFGEPPPYYYFYMDVWGKGTTVTVSS

SEQ ID NO: 2604 - protein, 21 aa, Artificial Sequence
  Description of Artificial Sequence: Synthetic peptide
ARRGGLWFGEPPPYYYFYMDV

SEQ ID NO: 2605 - protein, 113 aa, Artificial Sequence
  Description of Artificial Sequence: Synthetic polypeptide
DIVMTQSPLSLPVTPGESASISCRSSQSLLHSSGYNYVDWYMQKPGQSPQLLIYLGSNRASGVPDRFSGSGSGTDFTLKISRVEAEDVGVYYCMQTLQTPPFTFGQGTKLEIK

SEQ ID NO: 2606 - protein, 10 aa, Artificial Sequence
  Description of Artificial Sequence: Synthetic peptide
MQTLQTPPFT

SEQ ID NO: 2607 - protein, 125 aa, Artificial Sequence; identical to SEQ ID NO: 79
  Description of Artificial Sequence: Synthetic polypeptide

SEQ ID NO: 2608 - protein, 18 aa, Artificial Sequence
  Description of Artificial Sequence: Synthetic peptide
ANHPLASGDEYYYYYMDV

SEQ ID NO: 2609 - protein, 109 aa, Artificial Sequence
  Description of Artificial Sequence: Synthetic polypeptide
EIVLTQSPGTLSLSPGERATLSCRASQSVHSKQLAWYQQKPGQAPRLLIYGASSRATGIPDRFSGSGSGTDFTLTISRLEPEDFAVYYCQQYGSIRALTFGGGTKVEIK

SEQ ID NO: 2610 - protein, 10 aa, Artificial Sequence
  Description of Artificial Sequence: Synthetic peptide
QQYGSIRALT

SEQ ID NO: 2611 - protein, 117 aa, Artificial Sequence
  Description of Artificial Sequence: Synthetic polypeptide
EVQLVESGGGLVQPGGSLRLSCAASGFTVSSNYMSWVRQAPGKGLEWVSVIYSGGSTYYADSVKGRFTISRDNSKNTLYLHMNSLRAEDTAVFYCASHLMPDAFDIWGQGTMVTVSS

SEQ ID NO: 2612 - protein, 11 aa, Artificial Sequence
  Description of Artificial Sequence: Synthetic peptide
ASHLMPDAFDI

SEQ ID NO: 2613 - protein, 112 aa, Artificial Sequence
  Description of Artificial Sequence: Synthetic polypeptide
QSVLTQPASVSGSPGQSITISCTGTSSDVGSYNLVSWYQQHPGKAPKLMIYEVSKRPSGVSNRFSGSKSGNTASLTISGLQAEDEADYYCCSYGGSSTSFYVFGTGTKVTVL

SEQ ID NO: 2614 - protein, 12 aa, Artificial Sequence
  Description of Artificial Sequence: Synthetic peptide
CSYGGSSTSFYV

SEQ ID NO: 2615 - protein, 119 aa, Artificial Sequence
  Description of Artificial Sequence: Synthetic polypeptide
EVQLVESGGGLVQPGGSLRLSCAASGFTFSTYWMSWVRQPPGKGLEWVANIKQDGSEKYYVDSVKGRFTISRDNAKNSLYLQMNSLRADDTAVYYCAGGTWLRSSFDYWGQGTLVTVSS

SEQ ID NO: 2616 - protein, 12 aa, Artificial Sequence
  Description of Artificial Sequence: Synthetic peptide
AGGTWLRSSFDY

SEQ ID NO: 2617 - protein, 110 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVL

SEQ ID NO: 2618 - protein, 9 aa, Artificial Sequence
  Description of Artificial Sequence: Synthetic peptide
QSYDSSNWV

SEQ ID NO: 2619 - protein, 122 aa, Artificial Sequence
  Description of Artificial Sequence: Synthetic polypeptide
QVQLQESGPGLVKPSGTLSLTCAVSGGSISSNNWWSWVRQPPGKGLEWIGEIYHSGSTNYNPSLKSRVTISVDKSKNQFSLKLSSVTAADTAVYYCAKGGDRAMGPEYFDYWGQGTLVTVSS

SEQ ID NO: 2620 - protein, 15 aa, Artificial Sequence
  Description of Artificial Sequence: Synthetic peptide
AKGGDRAMGPEYFDY

SEQ ID NO: 2621 - protein, 110 aa, Artificial Sequence
  Description of Artificial Sequence: Synthetic polypeptide
QSVLTQPASVSGSPGQSITISCTGTSSDVGGYNYVSWYQQHPGKAPKLMIYDVSNRPSGVSNRFSGSKSGNTASLTISGLQAEDEADYYCSSFTSSSTLLFGGGTRLTVL

SEQ ID NO: 2622 - protein, 10 aa, Artificial Sequence
  Description of Artificial Sequence: Synthetic peptide
SSFTSSSTLL

SEQ ID NO: 2623 - protein, 125 aa, Artificial Sequence
  Description of Artificial Sequence: Synthetic polypeptide
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDTGRITFGGGDDAFDIWGQGTMVTVSS

SEQ ID NO: 2624 - protein, 18 aa, Artificial Sequence
  Description of Artificial Sequence: Synthetic peptide
ARDTGRITFGGGDDAFDI

SEQ ID NO: 2625 - protein, 108 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSKSGNTATLTISRVEAGDEADYYCQVWDSSSDHRVFGGGTKLTVL

SEQ ID NO: 2626 - protein, 11 aa, Artificial Sequence
  Description of Artificial Sequence: Synthetic peptide
QVWDSSSDHRV

SEQ ID NO: 2627 - protein, 122 aa, Artificial Sequence
  Description of Artificial Sequence: Synthetic polypeptide
QVQLQESGPGLVKPSQTLSLTCTVSGGSISSGGYYWNWIRQHPGKGLEWIGYIYYSGSTYYNPSLKSRVTISVDTSQNQFSLRLSSVTAADTAVYYCARGVVLITDYYFDYWGQGTLVTVSS

SEQ ID NO: 2628 - protein, 14 aa, Artificial Sequence
  Description of Artificial Sequence: Synthetic peptide
ARGVVLITDYYFDY

SEQ ID NO: 2629 - protein, 106 aa, Artificial Sequence
  Description of Artificial Sequence: Synthetic polypeptide
SYVLTQPPSVSVSPGQTARITCSGDTLPKQYVYWYQQKPGQAPALVIYKDSERPSGIPERLSGSSSGTTATLTISGVQAEDEADYYCQSADSSGTRFGGGTKLTVL

SEQ ID NO: 2630 - protein, 9 aa, Artificial Sequence
  Description of Artificial Sequence: Synthetic peptide
QSADSSGTR

SEQ ID NO: 2631 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTRYNPSLKSRVTISVDTSKNQFSLKLSSVTAADTAVFYCARGRGLPPWFDPWGQGTLVTVSS

SEQ ID NO: 2632 - protein, 12 aa, Artificial Sequence
  Description of Artificial Sequence: Synthetic peptide
ARGRGLPPWFDP

SEQ ID NO: 2633 - protein, 110 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNVVFGGGTKLTVL

SEQ ID NO: 2634 - protein, 9 aa, Artificial Sequence
  Description of Artificial Sequence: Synthetic peptide
QSYDSSNVV

SEQ ID NO: 2635 - protein, 120 aa, Artificial Sequence
  Description of Artificial Sequence: Synthetic polypeptide
QVQLVQSGAEVKKPGASVKVSCKASGYTFTSHYIHWVRQAPGQGLEWMGIINPSGGSTSYAQKFQGRVTMTRDTSTTTLYMDLSSLRSEDTAVYYCAKSRPTPDWYFDLWGRGTLVTVSS

SEQ ID NO: 2636 - protein, 13 aa, Artificial Sequence
  Description of Artificial Sequence: Synthetic peptide
AKSRPTPDWYFDL

SEQ ID NO: 2637 - protein, 110 aa, Artificial Sequence
  Description of Artificial Sequence: Synthetic polypeptide
SYVLTQPPSVSVAPGKTARITCGGNNIGSKSVHWYQQKPGQAPVLVIYYDNDRPSGIPERFSGSNSGNTATLTISRVEAGDEADYYCQVWDGGSDHPGVVFGGGTKLTVL

SEQ ID NO: 2638 - protein, 13 aa, Artificial Sequence
  Description of Artificial Sequence: Synthetic peptide
QVWDGGSDHPGVV

SEQ ID NO: 2639 - protein, 123 aa, Artificial Sequence
  Description of Artificial Sequence: Synthetic polypeptide
EVQLLESGGGLVQPGGSLRLSCAASGFTFSNYAMSWVRQAPGKGLEWVSAISGSDGSTYYAGSVKGRFTISRDNSKNTLYLQMNSLRAEDTAVYYCAKDPLITGPTYQYFHYWGQGTLVTVSS

SEQ ID NO: 2640 - protein, 16 aa, Artificial Sequence
  Description of Artificial Sequence: Synthetic peptide
AKDPLITGPTYQYFHY

SEQ ID NO: 2641 - protein, 110 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEAEYHCQVWDSSSDRPGVVFGGGTKLTVL

SEQ ID NO: 2642 - protein, 13 aa, Artificial Sequence
  Description of Artificial Sequence: Synthetic peptide
QVWDSSSDRPGVV

SEQ ID NO: 2643 - protein, 123 aa, Artificial Sequence
  Description of Artificial Sequence: Synthetic polypeptide
EVQLLESGGGLVQPGGSLRLSCAASGFTFSTYAMTWVRQAPGKGLEWVSAISGSGGRTYYADSVKGRFTISRDNSKNTLYLQMNSLRAEDTAVYYCAKVDYGEYVFSNAFDIWGQGTMVSVSS

SEQ ID NO: 2644 - protein, 16 aa, Artificial Sequence
  Description of Artificial Sequence: Synthetic peptide
AKVDYGEYVFSNAFDI

SEQ ID NO: 2645 - protein, 110 aa, Artificial Sequence
  Description of Artificial Sequence: Synthetic polypeptide
QSVLTQPASVSGSPGQSITISCTGTSSDVGSYNLVSWYQQHPDKAPKLMIYEVSKRPSGVSNRFSGSKSGNTASLTISGLQAEDEADYYCCSYAGTSTYVFGTGTKLTVL

SEQ ID NO: 2646 - protein, 10 aa, Artificial Sequence
  Description of Artificial Sequence: Synthetic peptide
CSYAGTSTYV

SEQ ID NO: 2647 - protein, 120 aa, Artificial Sequence
  Description of Artificial Sequence: Synthetic polypeptide
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARALQGPWLGADYWGQGTLVTVSS

SEQ ID NO: 2648 - protein, 13 aa, Artificial Sequence
  Description of Artificial Sequence: Synthetic peptide
ARALQGPWLGADY

SEQ ID NO: 2649 - protein, 110 aa, Artificial Sequence
  Description of Artificial Sequence: Synthetic polypeptide
  MOD_RES (11)..(11): Any amino acid
  MOD_RES (67)..(67): Any amino acid
  MOD_RES (79)..(79): Any amino acid
  MOD_RES (89)..(89): Any amino acid
NFMLNQPPCEXESPGKTVTISCTGSSGSIASNYDQWYQQRPGSAPTTVIYEDKQRTSGVLDWFSGSXARSSNSPSLTIXGRKREDEADXYCQSYDSSKGVFGGGTKLTVL

SEQ ID NO: 2650 - protein, 9 aa, Artificial Sequence
  Description of Artificial Sequence: Synthetic peptide
QSYDSSKGV

SEQ ID NO: 2651 - protein, 124 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARPDMSSSSSPHYWYFDLWGRGTLVTVSS

SEQ ID NO: 2652 - protein, 18 aa, Artificial Sequence
  Description of Artificial Sequence: Synthetic peptide
ARPDMSSSSSPHYWYFDL

SEQ ID NO: 2653 - protein, 110 aa, Artificial Sequence
  Description of Artificial Sequence: Synthetic polypeptide
SYVLTQPPSVSVAPGKTARITCGGNNIGSKNVHWYQQKPGQAPVLVVYYDSDRPSGIPERFSGSNSGNTATLTISRVEAGDEADYYCQVWDSSSGHFHVVFGGGTKLTVL

SEQ ID NO: 2654 - protein, 13 aa, Artificial Sequence
  Description of Artificial Sequence: Synthetic peptide
QVWDSSSGHFHVV

SEQ ID NO: 2655 - protein, 125 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARVVGYDFWSGYDGGYFDYWGQGTLVTVSS

SEQ ID NO: 2656 - protein, 19 aa, Artificial Sequence
  Description of Artificial Sequence: Synthetic peptide
ARVVGYDFWSGYDGGYFDY

SEQ ID NO: 2657 - protein, 110 aa, Artificial Sequence
  Description of Artificial Sequence: Synthetic polypeptide
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTWVFGGGTKLTVL

SEQ ID NO: 2658 - protein, 10 aa, Artificial Sequence
  Description of Artificial Sequence: Synthetic peptide
CSYAGSSTWV

SEQ ID NO: 2659 - protein, 122 aa, Artificial Sequence; identical to SEQ ID NO: 313
  Description of Artificial Sequence: Synthetic polypeptide

SEQ ID NO: 2660 - protein, 15 aa, Artificial Sequence
  Description of Artificial Sequence: Synthetic peptide
ARGGDTAMGPEYFDY

SEQ ID NO: 2661 - protein, 110 aa, Artificial Sequence
  Description of Artificial Sequence: Synthetic polypeptide
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLFGGGTKLTVL

SEQ ID NO: 2662 - protein, 10 aa, Artificial Sequence
  Description of Artificial Sequence: Synthetic peptide
SSYTSSSTLL

SEQ ID NO: 2663 - protein, 123 aa, Artificial Sequence
  Description of Artificial Sequence: Synthetic polypeptide
EVQLVESGGGLVKPGGSLRLSCAASGFSFRSYSMNWVRQAPGKGLEWVSSISSSSSYIYYADSVKGRFTISRDNAKNSLYLQMNSLRAEDTAVYYCARMGLELPGLDYGMDVWGQGTTVTVSS

SEQ ID NO: 2664 - protein, 16 aa, Artificial Sequence
  Description of Artificial Sequence: Synthetic peptide
ARMGLELPGLDYGMDV

SEQ ID NO: 2665 - protein, 110 aa, Artificial Sequence
  Description of Artificial Sequence: Synthetic polypeptide
QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSFNGPVFGGGTKLTVL

SEQ ID NO: 2666 - protein, 11 aa, Artificial Sequence
  Description of Artificial Sequence: Synthetic peptide
AAWDDSFNGPV

SEQ ID NO: 2667 - protein, 125 aa, Artificial Sequence
  Description of Artificial Sequence: Synthetic polypeptide
EVQLVESGGGLVKPGGSLRLSCAASGFTFSTYSMNWVRQAPGKGLEWVSSISSSSNYIYYADSVKGRFTISRDNAKNSLYLQMNSLRAEDTAVYYCARAKLEIAHYGGSPGFDYWGQGTLVTVSS

SEQ ID NO: 2668 - protein, 18 aa, Artificial Sequence
  Description of Artificial Sequence: Synthetic peptide
ARAKLEIAHYGGSPGFDY

SEQ ID NO: 2669 - protein, 107 aa, Artificial Sequence
  Description of Artificial Sequence: Synthetic polypeptide
SYELTQPPSVSVSPGQTASITCSGDKLGDKYTCWYQQKPGQSPVLVIYQDTQRPSGIPERFSGSNSGNTATLTISGTQAMDEADYYCQAWDSSTGVVFGGGTKVTVL

SEQ ID NO: 2670 - protein, 10 aa, Artificial Sequence
  Description of Artificial Sequence: Synthetic peptide
QAWDSSTGVV

SEQ ID NO: 2671 - protein, 121 aa, Artificial Sequence
  Description of Artificial Sequence: Synthetic polypeptide
QVQLVQSGAEVKKPGASVKVSCKASGYTFSSNYMHWVRQAPGQGLEWMGIINPSGGSTTYAQKFQGRVTMTRDTSTSTVYMELSSLRSEDTAVYYCARDLGYIPASDAFDIWGQGTMVTVS

SEQ ID NO: 2672 - protein, 15 aa, Artificial Sequence
  Description of Artificial Sequence: Synthetic peptide
ARDLGYIPASDAFDI

SEQ ID NO: 2673 - protein, 111 aa, Artificial Sequence
  Description of Artificial Sequence: Synthetic polypeptide
QSVLTQPRSVSGSPGQSVTISCTGTSSDFGGYNYVSWYQQHPGKAPKLMIYDVSKRPSGVPDRFSGSKSGNTASLTISGLQAEDEADYYCCSYAGSYTRYVFGTGTKVTVL

SEQ ID NO: 2674 - protein, 11 aa, Artificial Sequence
  Description of Artificial Sequence: Synthetic peptide
CSYAGSYTRYV

SEQ ID NO: 2675 - protein, 120 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTKYAQKLQGRVTMTTDTSTSTAYMELRSLRSDDTAVYFCARVLGIIVAGSLNWGQGTLVTVSS

SEQ ID NO: 2676 - protein, 13 aa, Artificial Sequence
  Description of Artificial Sequence: Synthetic peptide
ARVLGIIVAGSLN

SEQ ID NO: 2677 - protein, 110 aa, Artificial Sequence
  Description of Artificial Sequence: Synthetic polypeptide
NFVLTQPHSVSESPGKTVTISCTGSSGSIASNYVQWYQQRPGSAPTTVIYEDNQRPSGVPDRFSGSIDSSSNSASLTISGLKTEDEADYYCQSYDSSTWVFGGGTKLTVL

SEQ ID NO: 2678 - protein, 9 aa, Artificial Sequence
  Description of Artificial Sequence: Synthetic peptide
QSYDSSTWV

SEQ ID NO: 2679 - protein, 120 aa, Artificial Sequence
  Description of Artificial Sequence: Synthetic polypeptide
QVQLVQSGAEVKKPGASVKVSCKASGYTFTNYYMHWVRQAPGQGLEWMGIINPSGGSTGYAQKFQGRVTMTRDTSTSTVYMELSSLRSEDTAVYYCARSRPTPDWYFDLWGRGTLVTVSS

SEQ ID NO: 2680 - protein, 13 aa, Artificial Sequence
  Description of Artificial Sequence: Synthetic peptide
ARSRPTPDWYFDL

SEQ ID NO: 2681 - protein, 110 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPGVVFGGGTKLTVL

SEQ ID NO: 2682 - protein, 13 aa, Artificial Sequence
  Description of Artificial Sequence: Synthetic peptide
QVWDSSSDHPGVV

SEQ ID NO: 2683 - protein, 123 aa, Artificial Sequence; identical to SEQ ID NO: 2639
  Description of Artificial Sequence: Synthetic polypeptide

SEQ ID NO: 2684 - protein, 16 aa, Artificial Sequence
  Description of Artificial Sequence: Synthetic peptide
AKDPLITGPTYQYFHY

SEQ ID NO: 2685 - protein, 110 aa, Artificial Sequence; identical to SEQ ID NO: 2641
  Description of Artificial Sequence: Synthetic polypeptide

SEQ ID NO: 2686 - protein, 13 aa, Artificial Sequence
  Description of Artificial Sequence: Synthetic peptide
QVWDSSSDRPGVV

SEQ ID NO: 2687 - protein, 126 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNDGSSGWYPERGGGFDYWGQGTLVTVSS

SEQ ID NO: 2688 - protein, 19 aa, Artificial Sequence
  Description of Artificial Sequence: Synthetic peptide
ARNDGSSGWYPERGGGFDY

SEQ ID NO: 2689 - protein, 112 aa, Artificial Sequence
  Description of Artificial Sequence: Synthetic polypeptide
QSVLTQPPSVSGAPGQRVTISCTGSSSNIGAGYDVKWYQQLPGTAPKLLIYGNSNRPSGVPDRFSGSKSGTSASLAITGLQAEDEADYYCQSYDSSLSGLWVFGGGTKLTVL

SEQ ID NO: 2690 - protein, 12 aa, Artificial Sequence
  Description of Artificial Sequence: Synthetic peptide
QSYDSSLSGLWV

SEQ ID NO: 2691 - protein, 124 aa, Artificial Sequence
  Description of Artificial Sequence: Synthetic polypeptide
EVQLVESGGGLVKPGGSLRLSCAAASGFTISNAWMSWVRQAPGKGLEWVGRIKSKTDGGTTDYAAPVKGRFTISRDNSKNTLYLQMNSLKTEDTAVYYCTTDYSIRYYYGMDVWGQGTTVTVSS

SEQ ID NO: 2692 - protein, 14 aa, Artificial Sequence
  Description of Artificial Sequence: Synthetic peptide
TTDYSIRYYYGMDV

SEQ ID NO: 2693 - protein, 108 aa, Artificial Sequence
  Description of Artificial Sequence: Synthetic polypeptide
SYVLTQPPSVAVSPGQTARITCSGDALPKQYAYWYQQKPGQAPVLVIYKDSERPSGIPERFSGSSSGTTVTLTISGVQAEDEADYYCQSADSSGTYEVFGGGTKVTVL

SEQ ID NO: 2694 - protein, 11 aa, Artificial Sequence
  Description of Artificial Sequence: Synthetic peptide
QSADSSGTYEV

SEQ ID NO: 2695 - protein, 132 aa, Artificial Sequence
  Description of Artificial Sequence: Synthetic polypeptide
QVQLVESGGGVVQPGRSLRLSCAASGFTFSNYGMHWVRQAPGKGLEWVAVLSYEGSSTYYADSVKGRFTISRDNSKNTLYLQMNSLRAEDTAVYYCAKAGGRDYYDSSGYYLLDHYYGMDVWGQGTTVTVSS

SEQ ID NO: 2696 - protein, 25 aa, Artificial Sequence
  Description of Artificial Sequence: Synthetic peptide
AKAGGRDYYDSSGYYLLDHYYGMDV

SEQ ID NO: 2697 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGFYVFGTGTKVTVL

SEQ ID NO: 2698 - protein, 12 aa, Artificial Sequence
  Description of Artificial Sequence: Synthetic peptide
QSYDSSLSGFYV

SEQ ID NO: 2699 - protein, 126 aa, Artificial Sequence
  Description of Artificial Sequence: Synthetic polypeptide
QVQLVESGGGVVQPGRSLRLSCVASGFTFSSYGMHWVRQAPGKGLEWVAVIWYDGSNKYYADSVKGRFTISRDNSKNTLYLKMNSLRAEDTAVYYCARGEWDSGSYQYYDYYMDVWGKGTTVTVSS

SEQ ID NO: 2700 - protein, 19 aa, Artificial Sequence
  Description of Artificial Sequence: Synthetic peptide
ARGEWDSGSYQYYDYYMDV

SEQ ID NO: 2701 - protein, 110 aa, Artificial Sequence
  Description of Artificial Sequence: Synthetic polypeptide
QSVLTQEPSFSVSPGGTVTLTCGLSSGSVSTSYYPSWYQQTPGQPPRTLIYITNTRSSGVPDRFSGSILGNKAALTITGAQADDESDYYCVLYMGSSNWVFGGGTKLTVL

SEQ ID NO: 2702 - protein, 10 aa, Artificial Sequence
  Description of Artificial Sequence: Synthetic peptide
VLYMGSSNWV

SEQ ID NO: 2703 - protein, 119 aa, Artificial Sequence
  Description of Artificial Sequence: Synthetic polypeptide
QVQLQQWGAGLLKPSETLSLTCAVYGGSFSAYSWSWIRQPPGKGLEWIGEINHGGSTNYNASLKSRVTISADTSKNLFSLKLSSVTAADTAVYYCAREGAVAGGDFDYWGQGTLVTVSS

SEQ ID NO: 2704 - protein, 13 aa, Artificial Sequence
  Description of Artificial Sequence: Synthetic peptide
AREGAVAGGDFDY

SEQ ID NO: 2705 - protein, 110 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDGTSDHPGWVFGGGTKLTVL

SEQ ID NO: 2706 - protein, 13 aa, Artificial Sequence
  Description of Artificial Sequence: Synthetic peptide
QVWDGTSDHPGWV

SEQ ID NO: 2707 - protein, 122 aa, Artificial Sequence
  Description of Artificial Sequence: Synthetic polypeptide
QVQLVQSGAEVKKPGSSVKVSCKASGGTFSSYTISWVRQAPGHGLEWMGRIIPILGIANYAQKFQGRVTITADKSTSTAYMELSSLRSEDTAVYYCARFSNYCTSTSCYDYWGQGTLVTVSS

SEQ ID NO: 2708 - protein, 15 aa, Artificial Sequence
  Description of Artificial Sequence: Synthetic peptide
ARFSNYCTSTSCYDY

SEQ ID NO: 2709 - protein, 111 aa, Artificial Sequence
  Description of Artificial Sequence: Synthetic polypeptide
QSVLTQPPSVSGAPGQRVTISCTGSNSNIGAGYDVHWYQQLPGTAPKLLIYVNSNRPSGVPDRFSGSKSGTSASLAITGLQAEDEADYSCQSYDSSLSGSVFGTGTKVTVL

SEQ ID NO: 2710 - protein, 11 aa, Artificial Sequence
  Description of Artificial Sequence: Synthetic peptide
QSYDSSLSGSV

SEQ ID NO: 2711 - protein, 123 aa, Artificial Sequence
  Description of Artificial Sequence: Synthetic polypeptide
EVQLVQSGAEVKKPGESLKISCKGSGYSFTSYWIVWVRQMPGKGLERMGIIYPGDSDTRYSPSFQGQVTISADKSISTAYLQWSSLKASDTAMYYCARRGGSYYNNGDGMDVWGQGTTVTVSS

SEQ ID NO: 2712 - protein, 16 aa, Artificial Sequence
  Description of Artificial Sequence: Synthetic peptide
ARRGGSYYNNGDGMDV

SEQ ID NO: 2713 - protein, 108 aa, Artificial Sequence
  Description of Artificial Sequence: Synthetic polypeptide
SYVLTQPPSVSVSPGQTASITCFGDKLGDKYACWYQQKPGQSPVLVIYQDSKRPSGIPERFSGSNSGNTATLTISGTQAMDEADYYCQAWDSSTPHVVFGGGTKLTVL

SEQ ID NO: 2714 - protein, 11 aa, Artificial Sequence
  Description of Artificial Sequence: Synthetic peptide
QAWDSSTPHVV

SEQ ID NO: 2715 - protein, 124 aa, Artificial Sequence
  Description of Artificial Sequence: Synthetic polypeptide
QVQLVESGGGVVQPGRSLRLSCAASGFTFSSYAMFWVRQAPGKGLEWVAVISYDGSNKYYADSVKGRFTISRDNSKNTLYLQMNSLRAEDTAVYYCARADLGYCTNGVCYVDYWGQGTLVTVSS

SEQ ID NO: 2716 - protein, 17 aa, Artificial Sequence
  Description of Artificial Sequence: Synthetic peptide
ARADLGYCTNGVCYVDY

SEQ ID NO: 2717 - protein, 110 aa, Artificial Sequence; identical to SEQ ID NO: 2617
  Description of Artificial Sequence: Synthetic polypeptide

SEQ ID NO: 2718 - protein, 9 aa, Artificial Sequence
  Description of Artificial Sequence: Synthetic peptide
QSYDSSNWV

SEQ ID NO: 2719 - protein, 121 aa, Artificial Sequence
  Description of Artificial Sequence: Synthetic polypeptide
QVQLVESGGGVVQPGRSLRLSCAASGFTFSSYAIHWVRQAPGKGLEWVAVISNDGSNKYYEDSVKGRFTFSRDNSKNTLYLQMNSLRAEDTAVYYCARALSFIAVAGIDYWGRGTLVTVSS

SEQ ID NO: 2720 - protein, 14 aa, Artificial Sequence
  Description of Artificial Sequence: Synthetic peptide
ARALSFIAVAGIDY

SEQ ID NO: 2721 - protein, 111 aa, Artificial Sequence
  Description of Artificial Sequence: Synthetic polypeptide
NFMLTQPHSVSESPGKTVTISCTGSSGSIASNYVQWYQQRPGSAPTIVIYEDNQRPSGVPDRFSGSIDSSSNSASLTISGLKTEDEADYYCQSYDSTTHVVFGGGTKLIVL

SEQ ID NO: 2722 - protein, 10 aa, Artificial Sequence
  Description of Artificial Sequence: Synthetic peptide
QSYDSTTHVV

SEQ ID NO: 2723 - protein, 119 aa, Artificial Sequence
  Description of Artificial Sequence: Synthetic polypeptide
QVQLVESGGGVVQPGRSLRLSCAASGFTFSHYAMHWVRQAPGKGLEWVAVIPFDGSNKYYADSVKGRFTISRDNSKNTLYLQMNSLRAEDTAVYYCASSSGYLFHFDYWGQGTLVTVSS

SEQ ID NO: 2724 - protein, 12 aa, Artificial Sequence
  Description of Artificial Sequence: Synthetic peptide
ASSSGYLFHFDY

SEQ ID NO: 2725 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYPWTFGQGTKVEIK

SEQ ID NO: 2726 - protein, 9 aa, Artificial Sequence
  Description of Artificial Sequence: Synthetic peptide
QQYNSYPWT

SEQ ID NO: 2727 - protein, 120 aa, Artificial Sequence
  Description of Artificial Sequence: Synthetic polypeptide
QVQLVESGGGVVQPGRSLRLSCAASGFTFSSYAMHWVRQAPGKGLEWVAVISYDGTDSVKGRFTISRDTSKNMLYLQMNSLRAEDTAVYYCAKGPRFGWSYRGGPGFDIWGQGTMVTVSS

SEQ ID NO: 2728 - protein, 18 aa, Artificial Sequence
  Description of Artificial Sequence: Synthetic peptide
AKGPRFGWSYRGGPGFDI

SEQ ID NO: 2729 - protein, 107 aa, Artificial Sequence; identical to SEQ ID NO: 1009
  Description of Artificial Sequence: Synthetic polypeptide

SEQ ID NO: 2730 - protein, 9 aa, Artificial Sequence
  Description of Artificial Sequence: Synthetic peptide
QQYDNLPIT

SEQ ID NO: 2731 - protein, 117 aa, Artificial Sequence
  Description of Artificial Sequence: Synthetic polypeptide
EVQLVESGGDLVQPGGSLRLSCAASGLTVSSNYMSWVRQAPGKGLEWVSVIYSGGSTFYADSVKGRFTISRDNSQNTLYLQMNSLRAEDTAVYYCARDLQYYGMDVWGQGTTVTVSS

SEQ ID NO: 2732 - protein, 11 aa, Artificial Sequence
  Description of Artificial Sequence: Synthetic peptide
ARDLQYYGMDV

SEQ ID NO: 2733 - protein, 105 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQPDSFTFGPGTKVDIK

SEQ ID NO: 2734 - protein, 7 aa, Artificial Sequence
  Description of Artificial Sequence: Synthetic peptide
QQPDSFT

SEQ ID NO: 2735 - protein, 123 aa, Artificial Sequence
  Description of Artificial Sequence: Synthetic polypeptide
QVQLVESGGGVVQPGRSLRLSCAASGFTFSNYAMHWVRQAPGKGLEWVAVISYDGSKKYSADSVKGRFTISRDNSKNTLYLQMNSLRPVDTAVYYCARVRLGAYYNYFGMDVWGQGTTVTVSS

SEQ ID NO: 2736 - protein, 16 aa, Artificial Sequence
  Description of Artificial Sequence: Synthetic peptide
ARVRLGAYYNYFGMDV

SEQ ID NO: 2737 - protein, 111 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTFTFGPGTKVDIK

SEQ ID NO: 2738 - protein, 8 aa, Artificial Sequence
  Description of Artificial Sequence: Synthetic peptide
MQALQTFT

SEQ ID NO: 2739 - protein, 125 aa, Artificial Sequence
  Description of Artificial Sequence: Synthetic polypeptide
EVQLLESGGGLVQPGGSLRLSCAASGFTFSTYAMSWVRQAPGKGLEWVSTITGSGRDTYYADSVKGRFTISRDNSKNTLFLQLNSLRAEDAAVYSCANHPLASGDDYYHYYMDVWGKGTTVTVSS

SEQ ID NO: 2740 - protein, 18 aa, Artificial Sequence
  Description of Artificial Sequence: Synthetic peptide
ANHPLASGDDYYHYYMDV

SEQ ID NO: 2741 - protein, 109 aa, Artificial Sequence
  Description of Artificial Sequence: Synthetic polypeptide
EIVLTQSPGTLSLSPGERATLSCRASQSVNSRQLAWYQQKPGQAPRLLIYGASSRATGIPERFSGSGSGTDFTLTISRLESEDFAVYHCQQYGSSRALTFGGGTKVEIK

SEQ ID NO: 2742 - protein, 10 aa, Artificial Sequence
  Description of Artificial Sequence: Synthetic peptide
QQYGSSRALT

SEQ ID NO: 2743 - protein, 119 aa, Artificial Sequence
  Description of Artificial Sequence: Synthetic polypeptide
QVQLVESGGGVVQPGRSLRLSCAASGFTFSTYGMHWVRQAPGKGLEWVAVIWYDGNNKYYADSVKGRFTISRDNSKNTLYLQMNSLRAEDTAVYYCATSLFGIISLDYWGQGTLVTVSS

SEQ ID NO: 2744 - protein, 12 aa, Artificial Sequence
  Description of Artificial Sequence: Synthetic peptide
ATSLFGIISLDY

SEQ ID NO: 2745 - protein, 107 aa, Artificial Sequence
  Description of Artificial Sequence: Synthetic polypeptide
AIQMTQSPSSLSASVGDRVTITCRAGQGIRNDLGWYQQKPGKAPKLLIYAASSLQSGVPSRFSGSGSGTDFTLTISSLQPEDFATYYCLQDYNYPYTFGQGTKLEIK

SEQ ID NO: 2746 - protein, 9 aa, Artificial Sequence
  Description of Artificial Sequence: Synthetic peptide
LQDYNYPYT

SEQ ID NO: 2747 - protein, 125 aa, Artificial Sequence
  Description of Artificial Sequence: Synthetic polypeptide
QVQLVESGGGVVQPGRSLRLSCAASGFTFSSYGMNWVRQAPGKGLEWVAVISYDGSNTYYTDSVKGRFTISRDNSKNTLYLQMNSLRVDDTATYYCAKGPRFGWSYRGGSGFDIWGQGTMVTVSS

SEQ ID NO: 2748 - protein, 18 aa, Artificial Sequence
  Description of Artificial Sequence: Synthetic peptide
AKGPRFGWSYRGGSGFDI

SEQ ID NO: 2749 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSESGTDFTFTISSLQPEDIATYYCQQYDNLPITFGQGTRLEIK

SEQ ID NO: 2750 - protein, 9 aa, Artificial Sequence
  Description of Artificial Sequence: Synthetic peptide
QQYDNLPIT

SEQ ID NO: 2751 - protein, 127 aa, Artificial Sequence
  Description of Artificial Sequence: Synthetic polypeptide
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARTYYYDSSGYYFQYYFDCWGQGTLVTVSS

SEQ ID NO: 2752 - protein, 19 aa, Artificial Sequence
  Description of Artificial Sequence: Synthetic peptide
ARTYYYDSSGYYFQYYFDC

SEQ ID NO: 2753 - protein, 108 aa, Artificial Sequence
  Description of Artificial Sequence: Synthetic polypeptide
EIVLTQSPGTLSLSPGERATLSCRASLSVSSSYLAWYQQKPGQAPRLLIYGASSRATGIPDRFSGSGSGTDFTLTISRLEPEDFAVYYCQQYGSSPLTFGGGTKVEIK

SEQ ID NO: 2754 - protein, 9 aa, Artificial Sequence
  Description of Artificial Sequence: Synthetic peptide
QQYGSSPLT

SEQ ID NO: 2755 - protein, 117 aa, Artificial Sequence
  Description of Artificial Sequence: Synthetic polypeptide
EVQLVESGGGLVQPGGSLRLSCAASGVTVSSNYMSWVRQAPGKGLEWVSLIYSGGSTFYADSVKGRFTISRDNSENTLYLQMNTLRAEDTAVYYCARDLYYYGMDVWGQGTTVTVSS

SEQ ID NO: 2756 - protein, 11 aa, Artificial Sequence
  Description of Artificial Sequence: Synthetic peptide
ARDLYYYGMDV

SEQ ID NO: 2757 - protein, 107 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNSYSYTFGQGTKLEIK

SEQ ID NO: 2758 - protein, 9 aa, Artificial Sequence
  Description of Artificial Sequence: Synthetic peptide
QQLNSYSYT

SEQ ID NO: 2759 - protein, 122 aa, Artificial Sequence
  Description of Artificial Sequence: Synthetic polypeptide
EVQLVESGGGLVQPGGSLRLSCAASGFTFSSYWMSWVRQAPGKGLEWVANIKQDGSVKYYVDSVKGRFTISRDNAKNSLYLQMNSLRDEDTAVYYCARDQVSWYNLDAFDIWGQGTMVTVSS

SEQ ID NO: 2760 - protein, 15 aa, Artificial Sequence
  Description of Artificial Sequence: Synthetic peptide
ARDQVSWYNLDAFDI

SEQ ID NO: 2761 - protein, 112 aa, Artificial Sequence
  Description of Artificial Sequence: Synthetic polypeptide
DVVMTQSPLSLPVTLGQPASISCRSSQSLVYSDGDTYLNWFQQRPGQSPRRLIYKVSNRDSGVPDRFSGSGSGTDFTLKISRVEAEDVGVYYCMQGTHWPKTFGQGTKLEIK

SEQ ID NO: 2762 - protein, 9 aa, Artificial Sequence
  Description of Artificial Sequence: Synthetic peptide
MQGTHWPKT

SEQ ID NO: 2763 - protein, 122 aa, Artificial Sequence
  Description of Artificial Sequence: Synthetic polypeptide
QVQLVQSGAEVKKPGSSVKVSCKASGGTFSSYAINWVRQAPGQGLEWMGRIIPILDISNYAQKFQGRVTITADKSTSIAYMELSSLRSEDTAVYYCARGGYSYGQLYYFDYWGQGTLVTVSS

SEQ ID NO: 2764 - protein, 15 aa, Artificial Sequence
  Description of Artificial Sequence: Synthetic peptide
ARGGYSYGQLYYFDY

SEQ ID NO: 2765 - protein, 107 aa, Artificial Sequence
  Description of Artificial Sequence: Synthetic polypeptide
EIVLTQSPGTLSLPPGERATLSCRASQSVSSSYLAWYQQKPGQAPRLLIYGASSRATGIPDRFSGSGSGTDFTLTISRLEPEDFAVYYCQQYANSRTFGQGTKVEIK

SEQ ID NO: 2766 - protein, 8 aa, Artificial Sequence
  Description of Artificial Sequence: Synthetic peptide
QQYANSRT

SEQ ID NO: 2767 - protein, 120 aa, Artificial Sequence
  Description of Artificial Sequence: Synthetic polypeptide
QVQLVESGGGVVQPGRSLRLSCAASGFTFNNYGMHWVRQAPGKGLEWVAVIWYDGSNKYYADSVKGRFTISRDNSKNTVYLQMNSLRAEDTAVYYCARDWEIVVAGMDVWGQGTTVTVSS

SEQ ID NO: 2768 - protein, 13 aa, Artificial Sequence
  Description of Artificial Sequence: Synthetic peptide
ARDWEIVVAGMDV

SEQ ID NO: 2769 - protein, 112 aa, Artificial Sequence
  Description of Artificial Sequence: Synthetic polypeptide
DVVMTQSPLSLPVTLGQPASISCRSSQSLVYNDGNTYLNWFQQRPGQSPRRLIYKVSNRDSGVPDRFSGSGSGTDFTLKISRVEAEDVGVYYCMQGTHCPFTFGPGTKVDIK

SEQ ID NO: 2770 - protein, 9 aa, Artificial Sequence
  Description of Artificial Sequence: Synthetic peptide
MQGTHCPFT

SEQ ID NO: 2771 - protein, 121 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYSADSVKGRFTISRDNSKNTLYLQMNSLRAEDTAVYYCAKGGAYSYYYYMDVWGKGTTVTVSS

SEQ ID NO: 2772 - protein, 14 aa, Artificial Sequence
  Description of Artificial Sequence: Synthetic peptide
AKGGAYSYYYYMDV

SEQ ID NO: 2773 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIK

SEQ ID NO: 2774 - protein, 9 aa, Artificial Sequence
  Description of Artificial Sequence: Synthetic peptide
QQYDNLPLT

SEQ ID NO: 2775 - protein, 128 aa, Artificial Sequence
  Description of Artificial Sequence: Synthetic polypeptide
EVQLLESGGGLVQPGGSLRLSCVASRFTFSNYAMSWVRQAPGKGLEWVSTITGTGDHTYYADSVKGRFTISRDNSKNTLYLQMNSLRAEDTAIFYCANSPCSSASCKSGYYYYYMDVWGKGTTVTVSS

SEQ ID NO: 2776 - protein, 21 aa, Artificial Sequence
  Description of Artificial Sequence: Synthetic peptide
ANSPCSSASCKSGYYYYYMDV

SEQ ID NO: 2777 - protein, 109 aa, Artificial Sequence
  Description of Artificial Sequence: Synthetic polypeptide
EIVLTQSPGTLSLSPGERATLFCRASQSVTSSHLAWYQQKAGQAPRLLIYGASSRATGIPDRFSGSGSGTDFTLTISRLEPEDFAVYYCQQYGSSRSLTFGGGTKVEIK

SEQ ID NO: 2778 - protein, 10 aa, Artificial Sequence
  Description of Artificial Sequence: Synthetic peptide
QQYGSSRSLT

SEQ ID NO: 2779 - protein, 123 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKKQFSLKLSSVTAADTAVYYCATNYDDYVPAEYFQDWGQGTLVTVSS

SEQ ID NO: 2780 - protein, 15 aa, Artificial Sequence
  Description of Artificial Sequence: Synthetic peptide
ATNYDDYVPAEYFQD

SEQ ID NO: 2781 - protein, 108 aa, Artificial Sequence [sequence omitted]

SEQ ID NO: 2782 - protein, 10 aa, Artificial Sequence
  Description of Artificial Sequence: Synthetic peptide
QQRSNWPPLT

SEQ ID NO: 2783 - protein, 126 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDGTGIAAAGTANPPFDYWGQGTLVTVSS

SEQ ID NO: 2784 - protein, 19 aa, Artificial Sequence
  Description of Artificial Sequence: Synthetic peptide
ARDGTGIAAAGTANPPFDY

SEQ ID NO: 2785 - protein, 107 aa, Artificial Sequence; identical to SEQ ID NO: 2025
  Description of Artificial Sequence: Synthetic polypeptide

SEQ ID NO: 2786 - protein, 9 aa, Artificial Sequence
  Description of Artificial Sequence: Synthetic peptide
QQYDNLPYT

SEQ ID NO: 2787 - protein, 121 aa, Artificial Sequence
  Description of Artificial Sequence: Synthetic polypeptide
QLQLQESGPGLVKPSETLSLTCTVSGGSISSSSYYWGWIRQSPGKGLEWIGSIYYSGSTYYNPSLKSRVTISVDTSKNQFSLKLSSVTAADTAVYYCARRPPGDYYYMDVWGKGTTVTVSS

SEQ ID NO: 2788 - protein, 13 aa, Artificial Sequence
  Description of Artificial Sequence: Synthetic peptide
ARRPPGDYYYMDV

SEQ ID NO: 2789 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSIPQITFGQGTRLEIK

SEQ ID NO: 2790 - protein, 10 aa, Artificial Sequence
  Description of Artificial Sequence: Synthetic peptide
QQSYSIPQIT

SEQ ID NO: 2791 - protein, 125 aa, Artificial Sequence
  Description of Artificial Sequence: Synthetic polypeptide
EVQLVESGGVVVQPGGSLRLSCAASGFTFDDHTMHWVRQAPGKGLEWVSLISWDAGSTYYADSVKGRFTISRDNRKNFLYLQMNSLRTEDTALYYCAKGLNYRPQYYYYYGMDVWGQGTTVTVSS

SEQ ID NO: 2792 - protein, 18 aa, Artificial Sequence
  Description of Artificial Sequence: Synthetic peptide
AKGLNYRPQYYYYYGMDV

SEQ ID NO: 2793 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIK

SEQ ID NO: 2794 - protein, 9 aa, Artificial Sequence
  Description of Artificial Sequence: Synthetic peptide
MQALQTPWT

SEQ ID NO: 2795 - protein, 123 aa, Artificial Sequence
  Description of Artificial Sequence: Synthetic polypeptide
QVQLVESGGGVVQPGRSLRLSCAASGFTFSTYAMHWVRQAPGKGLEWVAVISYDGTNKFYADSVKGRFTISRDNSKNTLYLQMNSLRAEDTAVFYCARDSDVDTAMVTWFDYWGQGTLVTVSS

SEQ ID NO: 2796 - protein, 16 aa, Artificial Sequence
  Description of Artificial Sequence: Synthetic peptide
ARDSDVDTAMVTWFDY

SEQ ID NO: 2797 - protein, 108 aa, Artificial Sequence
  Description of Artificial Sequence: Synthetic polypeptide
DIQMTQSPSSLSASVGDRVTITCRASQSISSYLNWYQHKPGKAPKLLIYASSSLQSGVPSRFSGSGSGTDFTLTISSLQPEDFATYYCQQSYSTPPWTFGQGTKVEIK

SEQ ID NO: 2798 - protein, 10 aa, Artificial Sequence
  Description of Artificial Sequence: Synthetic peptide
QQSYSTPPWT

SEQ ID NO: 2799 - protein, 124 aa, Artificial Sequence
  Description of Artificial Sequence: Synthetic polypeptide
QVQLQESGPGLVKPSQTLSLTCTVSGGSISSGDYSWSWIRQPPGKGLEWIGYIYYSGSTYYNPSLKSRVTISVDTSKNQFSLKLSSVTAADTAVYYCVRVVMSGIAAAGQNDYWGQGTLVTVSS

SEQ ID NO: 2800 - protein, 16 aa, Artificial Sequence
  Description of Artificial Sequence: Synthetic peptide
VRVVMSGIAAAGQNDY

SEQ ID NO: 2801 - protein, 109 aa, Artificial Sequence
  Description of Artificial Sequence: Synthetic polypeptide
DIQMTQSPSSLSASVGDRVTITCQASQDISSYLNWYQQKPGKAPKLLIYDASNLETGVPSRFSGSGSGTDFTFTISSLQPEDIATYYCQQYDILPPMYTFGQGTKLEIK

SEQ ID NO: 2802 - protein, 11 aa, Artificial Sequence
  Description of Artificial Sequence: Synthetic peptide
QQYDILPPMYT

SEQ ID NO: 2803 - protein, 121 aa, Artificial Sequence
  Description of Artificial Sequence: Synthetic polypeptide
QVQLQESGPGLVKPSQTLSLTCTFSGGSISSGGHYWSWIRQHPGKGLEWIGYIYYSGSTYYNPSLKSRVIISVDTSKNQFSLRLSSVTAADTAVYYCARSCSSTSCPFDYWGQGTLVTVSS

SEQ ID NO: 2804 - protein, 13 aa, Artificial Sequence
  Description of Artificial Sequence: Synthetic peptide
ARSCSSTSCPFDY

SEQ ID NO: 2805 - protein, 107 aa, Artificial Sequence
  Description of Artificial Sequence: Synthetic polypeptide
DIQMTQSPSSLSASVGDRVTITCQASQDISNSLNWYQQKPGKAPKVLIYDASNLETGVPSRFSGSGSGTDFTFTISSLQPEDFATYYCQQYDNLPFTFGPGTKVDIK

SEQ ID NO: 2806 - protein, 9 aa, Artificial Sequence
  Description of Artificial Sequence: Synthetic peptide
QQYDNLPFT

SEQ ID NO: 2807 - protein, 116 aa, Artificial Sequence
  Description of Artificial Sequence: Synthetic polypeptide
EVQLVETGGGLIQPGGSLRLSCAASGITVSSNYMSWVRQAPGKGLEWVSIIYSGGSTFYADSVKGRFTISRDNPKNTLYLQMNSLRAEDTAVYYCARDLYYYGMDVWGQGTTVTVS

SEQ ID NO: 2808 - protein, 11 aa, Artificial Sequence
  Description of Artificial Sequence: Synthetic peptide
ARDLYYYGMDV

SEQ ID NO: 2809 - protein, 106 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNSYPTFGQGTKLEIK

SEQ ID NO: 2810 - protein, 8 aa, Artificial Sequence
  Description of Artificial Sequence: Synthetic peptide
QQLNSYPT

SEQ ID NO: 2811 - protein, 125 aa, Artificial Sequence
  Description of Artificial Sequence: Synthetic polypeptide
EVQLLESGGGLVQPGGSLRLSCAASGFTFSSYAMSWVRQAPGKGLEWISAISGSGGRTYNADSVKGRFTISRDNSKNTLYLQMNSLRAEDTAVYYCAKAGPAAAYGWYYYYMDVWGKGTTVTASS

SEQ ID NO: 2812 - protein, 18 aa, Artificial Sequence
  Description of Artificial Sequence: Synthetic peptide
AKAGPAAAYGWYYYYMDV

SEQ ID NO: 2813 - protein, 108 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVSTYYCQKYNSALGFTFGPGTKVDIK

SEQ ID NO: 2814 - protein, 10 aa, Artificial Sequence
  Description of Artificial Sequence: Synthetic peptide
QKYNSALGFT

SEQ ID NO: 2815 - protein, 122 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDGITGTIEYYFDYWGQGTLVTVSS

SEQ ID NO: 2816 - protein, 15 aa, Artificial Sequence
  Description of Artificial Sequence: Synthetic peptide
ARDGITGTIEYYFDY

SEQ ID NO: 2817 - protein, 109 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPGVTFGQGTRLEIK

SEQ ID NO: 2818 - protein, 11 aa, Artificial Sequence
  Description of Artificial Sequence: Synthetic peptide
QQRSNWPPGVT

SEQ ID NO: 2819 - protein, 122 aa, Artificial Sequence
  Description of Artificial Sequence: Synthetic polypeptide
QVQLVQSGAEVKKPGASVKVSCKASGYTFTSYYIHWVRQAPGQGLEWMGIINPSAGSTSYAQKFQGRVTMTRDTSTSTVYMELSSLRSEDTAVYYCARDIALVPAAMGLDYWGQGTLVTVSS

SEQ ID NO: 2820 - protein, 15 aa, Artificial Sequence
  Description of Artificial Sequence: Synthetic peptide
ARDIALVPAAMGLDY

SEQ ID NO: 2821 - protein, 107 aa, Artificial Sequence
  Description of Artificial Sequence: Synthetic polypeptide
DIQMTQSPSSLSASVGDRVTITCRASQSSSRYLNWYQQKPGKAPKLLIYAASSLQSGVPSRFSGSGSGTDFTLTISSLQPEDFATYYCQQSYRTRLTFGGGTKVEIK

SEQ ID NO: 2822 - protein, 9 aa, Artificial Sequence
  Description of Artificial Sequence: Synthetic peptide
QQSYRTRLT

SEQ ID NO: 2823 - protein, 122 aa, Artificial Sequence
  Description of Artificial Sequence: Synthetic polypeptide
QVQLVQSGSEVKKPGSSVKVSCKASGGTFSSYAFSWVRQAPGQGLEWMGRIIPILALANYAQKFQGRVTITADKSTSTAYMELSSLRSEDTAVYYCARVNQAVTTPFSMDVWGQGTTVTVSS

SEQ ID NO: 2824 - protein, 15 aa, Artificial Sequence
  Description of Artificial Sequence: Synthetic peptide
ARVNQAVTTPFSMDV

SEQ ID NO: 2825 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPITFGQGTRLEIK

SEQ ID NO: 2826 - protein, 9 aa, Artificial Sequence
  Description of Artificial Sequence: Synthetic peptide
QQYNNWPIT

SEQ ID NO: 2827 - protein, 122 aa, Artificial Sequence
  Description of Artificial Sequence: Synthetic polypeptide
QVQLVQSGAEVKKPGSSVKVSCKASGDTFSSSALSWVRQAPGQGLEWMGRIIPILGITNYAQKFQGRVTITADKSTSTAYMELNSLRSEDTAVYYCARANQPVTTPFSMDVWGQGTTVTVSS

SEQ ID NO: 2828 - protein, 15 aa, Artificial Sequence
  Description of Artificial Sequence: Synthetic peptide
ARANQPVTTPFSMDV

SEQ ID NO: 2829 - protein, 107 aa, Artificial Sequence
  Description of Artificial Sequence: Synthetic polypeptide
EIVMTQSPATLSVSPGERATLSCRASQSVSSNLAWYQQKPGQAPRLLIYAASTRATGIPARFSGSGSGTEFTLTISSLQSEDFAVYYCQQYNNWPITFGQGTRLEIK

SEQ ID NO: 2830 - protein, 9 aa, Artificial Sequence
  Description of Artificial Sequence: Synthetic peptide
QQYNNWPIT

SEQ ID NO: 2831 - protein, 120 aa, Artificial Sequence
  Description of Artificial Sequence: Synthetic polypeptide
EVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKDITMIVDVFEYWGQGTLVTVSS

SEQ ID NO: 2832 - protein, 13 aa, Artificial Sequence
  Description of Artificial Sequence: Synthetic peptide
VKDITMIVDVFEY

SEQ ID NO: 2833 - protein, 107 aa, Artificial Sequence
  Description of Artificial Sequence: Synthetic polypeptide
DIQMTQSPSSLSASVGDRVTITCRASQSISNYLNWYQQKPGKAPKLLIYAASSLQSAVPSRFSGSGSGTDFTLTISSLQPEDFATYFCQQSYTTPYTFGQGTKLEIK

SEQ ID NO: 2834 - protein, 9 aa, Artificial Sequence
  Description of Artificial Sequence: Synthetic peptide
QQSYTTPYT

SEQ ID NO: 2835 - protein, 117 aa, Artificial Sequence
  Description of Artificial Sequence: Synthetic polypeptide
EVQLVESGGGLIQPGGSLRLSCAASGFTVSSNYMSWVRQAPGKGLEWISVIYSGGSTFYADSVKGRFTISRDNSKDTLYLQMNRLRAEDTAVYYCARSFYFDAFDIWGQGTMVTVSS

SEQ ID NO: 2836 - protein, 11 aa, Artificial Sequence
  Description of Artificial Sequence: Synthetic peptide
ARSFYFDAFDI

SEQ ID NO: 2837 - protein, 108 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNSYPLLTFGGGTKVEIK

SEQ ID NO: 2838 - protein, 10 aa, Artificial Sequence
  Description of Artificial Sequence: Synthetic peptide
QQLNSYPLLT

SEQ ID NO: 2839 - protein, 121 aa, Artificial Sequence; identical to SEQ ID NO: 85
  Description of Artificial Sequence: Synthetic polypeptide

SEQ ID NO: 2840 - protein, 14 aa, Artificial Sequence
  Description of Artificial Sequence: Synthetic peptide
ARGVVAATPGNFDI

SEQ ID NO: 2841 - protein, 106 aa, Artificial Sequence; identical to SEQ ID NO: 86
  Description of Artificial Sequence: Synthetic polypeptide

SEQ ID NO: 2842 - protein, 8 aa, Artificial Sequence
  Description of Artificial Sequence: Synthetic peptide
QQYNNGLT

SEQ ID NO: 2843 - protein, 126 aa, Artificial Sequence
  Description of Artificial Sequence: Synthetic polypeptide
QVQLVQSGAEVKKPGSSVKVSCKASGGTVNNYAINWVRQAPGQGLEWMGGIVPIFGTPNYAQKFQGRVTITADESTSTAYMELSSLRSEDTAVYYCAKVSLTLPIAAAPRFWFDSWGQGTLVTVSS

SEQ ID NO: 2844 - protein, 19 aa, Artificial Sequence
  Description of Artificial Sequence: Synthetic peptide
AKVSLTLPIAAAPRFWFDS

SEQ ID NO: 2845 - protein, 109 aa, Artificial Sequence
  Description of Artificial Sequence: Synthetic polypeptide
EIVMTQSPATLSVSPGERATLSCRASQSVSSHLAWYQQKPGQAPRLLIYGASTRATGIPARFSGSGSGTEFTLTISSLQSEDFAVYYCQQYHNWPPALTFGGGTKVEIK

SEQ ID NO: 2846 - protein, 11 aa, Artificial Sequence
  Description of Artificial Sequence: Synthetic peptide
QQYHNWPPALT

SEQ ID NO: 2847 - protein, 122 aa, Artificial Sequence
  Description of Artificial Sequence: Synthetic polypeptide
QVQLVQSGAEVKKPGASVKVSCKVSGYTLTELSMHWVRQAPGKGLEWMGGFDPEDGETIYVQKFQGRATMTEHTSTETAYMELSSLRSEDTAVYYCATNAEIAARKGGMDVWGQGTTVTVSS

SEQ ID NO: 2848 - protein, 15 aa, Artificial Sequence
  Description of Artificial Sequence: Synthetic peptide
ATNAEIAARKGGMDV

SEQ ID NO: 2849 - protein, 112 aa, Artificial Sequence
  Description of Artificial Sequence: Synthetic polypeptide
DIVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPWTFGQGTKVEIK

SEQ ID NO: 2850 - protein, 9 aa, Artificial Sequence
  Description of Artificial Sequence: Synthetic peptide
MQALQTPWT

SEQ ID NO: 2851 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNMLYLQMNSLRAEDTAVYYCAKQNGLYCSGGSCYLGYFDYWGQGTLVTVSS

SEQ ID NO: 2852 - protein, 20 aa, Artificial Sequence
  Description of Artificial Sequence: Synthetic peptide
AKQNGLYCSGGSCYLGYFDY

SEQ ID NO: 2853 - protein, 107 aa, Artificial Sequence
  Description of Artificial Sequence: Synthetic polypeptide
DIQMTQSPSSLSASVGDRVTITCQASQDISNYLNWFQQKPGKAPKLLIYAASDLETGVPSRFSGSGSGTDFTFTISSLQPEDIASYYCLQYDNLPLTFGGGTKVEIK

SEQ ID NO: 2854 - protein, 9 aa, Artificial Sequence
  Description of Artificial Sequence: Synthetic peptide
LQYDNLPLT

SEQ ID NO: 2855 - protein, 127 aa, Artificial Sequence
  Description of Artificial Sequence: Synthetic polypeptide
QVQLVESGGGVVQPGRSLRLSCAVSGFTFSSYGMHWVRQAPGKGLEWVAVISYDGSNKHYADSVKGRFTISRDNSKNTLYVQMNSLRAEDTAMYYCAKQLGLYCSGGNCYSGALDYWGQGTLVTVSS

SEQ ID NO: 2856 - protein, 20 aa, Artificial Sequence
  Description of Artificial Sequence: Synthetic peptide
AKQLGLYCSGGNCYSGALDY

SEQ ID NO: 2857 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPFTFGPGTKVDIK

SEQ ID NO: 2858 - protein, 9 aa, Artificial Sequence
  Description of Artificial Sequence: Synthetic peptide
QQYDNLPFT

SEQ ID NO: 2859 - protein, 123 aa, Artificial Sequence
  Description of Artificial Sequence: Synthetic polypeptide
QMQLVQSGPEVKKPGTSVKVSCKASGFTFTNSAVQWVRQSRRQRLEWIGWIVVGSGNTNYAQKFQERVTITRDMSTSTAYMELSSLRSEDTAVYYCAAVDCNSTSCYDAFDIWGQGTMVTVSS

SEQ ID NO: 2860 - protein, 16 aa, Artificial Sequence
  Description of Artificial Sequence: Synthetic peptide
AAVDCNSTSCYDAFDI

SEQ ID NO: 2861 - protein, 108 aa, Artificial Sequence; identical to SEQ ID NO: 90
  Description of Artificial Sequence: Synthetic polypeptide

SEQ ID NO: 2862 - protein, 9 aa, Artificial Sequence
  Description of Artificial Sequence: Synthetic peptide
QQYDISPWT

SEQ ID NO: 2863 - protein, 119 aa, Artificial Sequence
  Description of Artificial Sequence: Synthetic polypeptide
QVQLVESGGGVVQPGRSLRLSCAASGFTFSSYAMHWVRQAPGKGLEWVAVIPFDGRNKYYADSVTGRFTISRDNSKNTLYLQMNSLRAEDTAVYYCASSSGYLFHSDYWGQGTLVTVSS

SEQ ID NO: 2864 - protein, 12 aa, Artificial Sequence
  Description of Artificial Sequence: Synthetic peptide
ASSSGYLFHSDY

SEQ ID NO: 2865 - protein, 107 aa, Artificial Sequence
  Description of Artificial Sequence: Synthetic polypeptide
  MOD_RES (52)..(52): Any amino acid
DIQMTQSPSTLSASVGDRVTITCRASQSISNWLAWFQQKPGKAPKLLIYEAXSLESGVPSRFSGSGSGTEFTLTISSLQPDDFATYYCQQYNSYPWTFGQGTKVEIK

SEQ ID NO: 2866 - protein, 9 aa, Artificial Sequence
  Description of Artificial Sequence: Synthetic peptide
QQYNSYPWT

SEQ ID NO: 2867 - protein, 116 aa, Artificial Sequence; identical to SEQ ID NO: 87
  Description of Artificial Sequence: Synthetic polypeptide

SEQ ID NO: 2868 - protein, 10 aa, Artificial Sequence
  Description of Artificial Sequence: Synthetic peptide
ARDIAGRLDY

SEQ ID NO: 2869 - protein, 108 aa, Artificial Sequence; identical to SEQ ID NO: 88
  Description of Artificial Sequence: Synthetic polypeptide

SEQ ID NO: 2870 - protein, 10 aa, Artificial Sequence
  Description of Artificial Sequence: Synthetic peptide
QHYDSLSRLT

SEQ ID NO: 2871 - protein, 122 aa, Artificial Sequence
  Description of Artificial Sequence: Synthetic polypeptide
QVQLVQSGAEVKKPGSSVKVSCKASGGTFSSYAINWVRQAPGQGLEWMGRIIPIVGIANYAQKFQGRVTITADKSSSTAYMELSSLRSEDTAVYYCARDLLDPQLDDAFDIWGQGTMVTVSS

SEQ ID NO: 2872 - protein, 15 aa, Artificial Sequence
  Description of Artificial Sequence: Synthetic peptide
ARDLLDPQLDDAFDI

SEQ ID NO: 2873 - protein, 108 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPWTFGQGTKVEIK

SEQ ID NO: 2874 - protein, 9 aa, Artificial Sequence
  Description of Artificial Sequence: Synthetic peptide
QQYGSSPWT

SEQ ID NO: 2875 - protein, 124 aa, Artificial Sequence
  Description of Artificial Sequence: Synthetic polypeptide
QVQLQQSGPGLVKPSQTLSLTCAISGDSVSSNSTAWNWIRQSPSRGLEWLGRTYYRSKWYNHYALSVKSRITINPDTSKNQFSLQLNSVTPEDTAVYYCARSGSYYISHGMDVWGQGTTVTVSS

SEQ ID NO: 2876 - protein, 14 aa, Artificial Sequence
  Description of Artificial Sequence: Synthetic peptide
ARSGSYYISHGMDV

SEQ ID NO: 2877 - protein, 108 aa, Artificial Sequence
  Description of Artificial Sequence: Synthetic polypeptide
EIVMTQSPATLSVSPGERATLSCRASQSVSSNLAWYQQRPGQAPRLLIYGASTRATGIPARFSGSGSGTEFTLTISSLQSEDFAVYYCQQYNNWPPWTFGQGTKVEIK

SEQ ID NO: 2878 - protein, 10 aa, Artificial Sequence [sequence omitted]

SEQ ID NO: 2879 - protein, 125 aa, Artificial Sequence
  Description of Artificial Sequence: Synthetic polypeptide
EVQLLESGGGLVQPGGSLRLSCAASGFTFSTYAMSWVRQAPGKGLEWVSTITGSGGFTYYADSVKGRFTISRDNSKNTLFLQMNSLRAEDAAVYYCANHPLASGDEYYYYYMDVWGKGTTVTVSS

SEQ ID NO: 2880 - protein, 18 aa, Artificial Sequence
  Description of Artificial Sequence: Synthetic peptide
ANHPLASGDEYYYYYMDV

SEQ ID NO: 2881 - protein, 109 aa, Artificial Sequence
  Description of Artificial Sequence: Synthetic polypeptide
EIVLTQSPGTLSLSPGERATLSCRASQSVNSRQLAWYQQKPGQGPRLLIYGASSRATGIPDRFSGSGSGTDFTLTISRLEPEDFAVYYCQQYGSSRALTFGGGTKVEIK

SEQ ID NO: 2882 - protein, 10 aa, Artificial Sequence
  Description of Artificial Sequence: Synthetic peptide
QQYGSSRALT

SEQ ID NO: 2883 - protein, 123 aa, Artificial Sequence
  Description of Artificial Sequence: Synthetic polypeptide
QVQLVESGGGVVQPGRSLRLSCAASGFTFSSYAMHWVRQAPGKGLEWVAVILYDGSNKYYADSVKGRFTISRDNSKNTLYLQMNSLRAEDTAVYYCARDSDVDTSMVTWFDYWGQGTLVTVSS

SEQ ID NO: 2884 - protein, 16 aa, Artificial Sequence
  Description of Artificial Sequence: Synthetic peptide
ARDSDVDTSMVTWFDY

SEQ ID NO: 2885 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK

SEQ ID NO: 2886 - protein, 10 aa, Artificial Sequence
  Description of Artificial Sequence: Synthetic peptide
QQSYSTPPWT

SEQ ID NO: 2887 - protein, 123 aa, Artificial Sequence
  Description of Artificial Sequence: Synthetic polypeptide
QVQLVESGGGLVKPGGSLRLSCAASGFTFSHYNMIWIRQAPGKGLEWVSYISSSSSYTNCSDSVRGRFTISRDNAKNSLYLQMNSLRAEDTAVYYCARDRGYSGYGLDRFDYWGQGTLVTVSS

SEQ ID NO: 2888 - protein, 16 aa, Artificial Sequence
  Description of Artificial Sequence: Synthetic peptide
ARDRGYSGYGLDRFDY

SEQ ID NO: 2889 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASHLETGVPSRFSGSGSGTDFTFTISSLQPEDIATYYCQQYDNLPLTFGGGTKVEIK

SEQ ID NO: 2890 - protein, 9 aa, Artificial Sequence
  Description of Artificial Sequence: Synthetic peptide
QQYDNLPLT

SEQ ID NO: 2891 - protein, 117 aa, Artificial Sequence; identical to SEQ ID NO: 83
  Description of Artificial Sequence: Synthetic polypeptide

SEQ ID NO: 2892 - protein, 11 aa, Artificial Sequence
  Description of Artificial Sequence: Synthetic peptide
ARDLVVYGADY

SEQ ID NO: 2893 - protein, 107 aa, Artificial Sequence; identical to SEQ ID NO: 84
  Description of Artificial Sequence: Synthetic polypeptide

SEQ ID NO: 2894 - protein, 9 aa, Artificial Sequence
  Description of Artificial Sequence: Synthetic peptide
QQLNSYPPP

SEQ ID NO: 2895 - protein, 129 aa, Artificial Sequence
  Description of Artificial Sequence: Synthetic polypeptide
EVQLLESGGGLVQPGGSLRLSCTASGFTFSTYAMSWVRQAPGKGLEWVSAISDSGGSTYYADSVKGRFTISRDNSKNTLYLQMNSLRAEDTAVYYCAKSKTVERLPYCGGDCFSAIDYWGQGTLVTVSS

SEQ ID NO: 2896 - protein, 22 aa, Artificial Sequence
  Description of Artificial Sequence: Synthetic peptide
AKSKTVERLPYCGGDCFSAIDY

SEQ ID NO: 2897 - protein, 108 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPPFTFGPGTKVHIK

SEQ ID NO: 2898 - protein, 10 aa, Artificial Sequence
  Description of Artificial Sequence: Synthetic peptide
QQYDNLPPFT

SEQ ID NO: 2899 - protein, 133 aa, Artificial Sequence
  Description of Artificial Sequence: Synthetic polypeptide
QVQLVESGGGLVKPGGSLRLSCAASGFTFSDYYMTWIRQAPGKGLEWVSYITTSSSYTNYADSVKGRFTISRDNAKNSLYLQMNSLRAEDTAVYYCARDNITMVRGVIVRPNDGGYYYALDVWGQGTTVTVSS

SEQ ID NO: 2900 - protein, 26 aa, Artificial Sequence
  Description of Artificial Sequence: Synthetic peptide
ARDNITMVRGVIVRPNDGGYYYALDV

SEQ ID NO: 2901 - protein, 108 aa, Artificial Sequence
  Description of Artificial Sequence: Synthetic polypeptide
DIQMTQSPSSLSASVGDRVTITCRASQSISSYLNWYQEKPGKAPKLLIYAASSLQSGVPSRFSGSGSGTDFTLTISSLQPEDFATYYCQQSYSTRALTFGGGTKVEIK

SEQ ID NO: 2902 - protein, 10 aa, Artificial Sequence
  Description of Artificial Sequence: Synthetic peptide
QQSYSTRALT

SEQ ID NO: 2903 - protein, 118 aa, Artificial Sequence
  Description of Artificial Sequence: Synthetic polypeptide
EVQLVESGGGLIQPGGSLRLSCAASGFIVSRNYMSWVRQAPGKGLEWVSVIYSGGSTYYADSVKGRFTISRDNSKNTLYLQMNSLRADDTAVYYCTRDPVPGRGDAYWGQGTLVTVSS

SEQ ID NO: 2904 - protein, 12 aa, Artificial Sequence
  Description of Artificial Sequence: Synthetic peptide
TRDPVPGRGDAY

SEQ ID NO: 2905 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISTLQPEDIATYYCQQYDNLPITFGGGTKVEIK

SEQ ID NO: 2906 - protein, 9 aa, Artificial Sequence
  Description of Artificial Sequence: Synthetic peptide
QQYDNLPIT

SEQ ID NO: 2907 - protein, 126 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKKGQPYCGGDCYFYYFDYWGQGTLVTVSS

SEQ ID NO: 2908 - protein, 19 aa, Artificial Sequence
  Description of Artificial Sequence: Synthetic peptide
AKKGQPYCGGDCYFYYFDY

SEQ ID NO: 2909 - protein, 108 aa, Artificial Sequence
  Description of Artificial Sequence: Synthetic polypeptide
DIQMTQSPSSLSASLGDRVTITCQASQDISNYLNWYQQKPGKAPKLLIYDASNLETGVPSRFSGSGSGTDFTFTISSLQPEDIATYYCQQYDNLPPITFGQGTRLEIK

SEQ ID NO: 2910 - protein, 10 aa, Artificial Sequence
  Description of Artificial Sequence: Synthetic peptide
QQYDNLPPIT

SEQ ID NO: 2911 - protein, 121 aa, Artificial Sequence
  Description of Artificial Sequence: Synthetic polypeptide
QVQLVESGGGVVQPGRSLRLSCAASGFTFSSYTMHWVRQAPGKGLEWVAVISYDGSIKYYADSVKGRFTISRDNSKNTLYLQMNSLRAEDTAVYYCARDSDTAMVDYFDYWGQGTLVTVSS

SEQ ID NO: 2912 - protein, 14 aa, Artificial Sequence
  Description of Artificial Sequence: Synthetic peptide
ARDSDTAMVDYFDY

SEQ ID NO: 2913 - protein, 108 aa, Artificial Sequence
  Description of Artificial Sequence: Synthetic polypeptide
DIQMTQSPSSLSASVGDRVTITCRASQSISSYLNWYQQKAGKAPKLLIYAASSLQSGVPSRFSGSGSGTDFTLTISSLQPEDFATYYCQQSYSTFMYTFGQGTKLEIK

SEQ ID NO: 2914 - protein, 10 aa, Artificial Sequence
  Description of Artificial Sequence: Synthetic peptide
QQSYSTFMYT

SEQ ID NO: 2915 - protein, 123 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRCTISRDNSKNTLFLQMNSLRPEDTAVYYCAKVDLKYSYGLYYFDYWGQGTLVTVSS

SEQ ID NO: 2916 - protein, 16 aa, Artificial Sequence
  Description of Artificial Sequence: Synthetic peptide
AKVDLKYSYGLYYFDY

SEQ ID NO: 2917 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQTYITPPSFGPGTKVDIK

SEQ ID NO: 2918 - protein, 9 aa, Artificial Sequence
  Description of Artificial Sequence: Synthetic peptide
QQTYITPPS

SEQ ID NO: 2919 - protein, 117 aa, Artificial Sequence
  Description of Artificial Sequence: Synthetic polypeptide
EVQLVESGGGLVQPGGSLRLSCAASGITVSSNYMSWVRQAPGKGLEWVSVIYSGGSTYYADSVKGRVTISRDNSKNTLYLQMNSLRVEDTAVYYCARDLGDYGMDVWGQGTTVTVSS

SEQ ID NO: 2920 - protein, 11 aa, Artificial Sequence
  Description of Artificial Sequence: Synthetic peptide
ARDLGDYGMDV

SEQ ID NO: 2921 - protein, 108 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIK

SEQ ID NO: 2922 - protein, 10 aa, Artificial Sequence
  Description of Artificial Sequence: Synthetic peptide
QQLNSYPPYT

SEQ ID NO: 2923 - protein, 126 aa, Artificial Sequence; identical to SEQ ID NO: 143
  Description of Artificial Sequence: Synthetic polypeptide

SEQ ID NO: 2924 - protein, 19 aa, Artificial Sequence
  Description of Artificial Sequence: Synthetic peptide
ARREPYGPRDYYYFFGMDV

SEQ ID NO: 2925 - protein, 115 aa, Artificial Sequence
  Description of Artificial Sequence: Synthetic polypeptide
QSVLTQPPFASASLGASVTLTCTLSSDYSYYKVDWYQQRPGKGPRFVIRVGPGGIVGSKGDGFPDRFSVLGSGLNRSLTINNIQEEDEGDYHCGADEGSGGTFVGVFGGGTKLTV

SEQ ID NO: 2926 - protein, 13 aa, Artificial Sequence
  Description of Artificial Sequence: Synthetic peptide
GADEGSGGTFVGV

SEQ ID NO: 2927 - protein, 120 aa, Artificial Sequence; identical to SEQ ID NO: 149
  Description of Artificial Sequence: Synthetic polypeptide

SEQ ID NO: 2928 - protein, 13 aa, Artificial Sequence
  Description of Artificial Sequence: Synthetic peptide
ARAGTTNSDYFDY

SEQ ID NO: 2929 - protein, 108 aa, Artificial Sequence
  Description of Artificial Sequence: Synthetic polypeptide
SYVLTQPPSVSVAPGMTARITCGGNTIGSKSVHWYQQKAGQAPVLVIYYDSDRPSGIPERFSGSNSGNTATLTISRVEAGDEADYYCQVWDSSSVLWVFGGGTKLTVL

SEQ ID NO: 2930 - protein, 11 aa, Artificial Sequence
  Description of Artificial Sequence: Synthetic peptide
QVWDSSSVLWV

SEQ ID NO: 2931 - protein, 122 aa, Artificial Sequence
  Description of Artificial Sequence: Synthetic polypeptide
QVQLVQSGAEVKKPGASVKVSCKASGYTFTSHGINWVRQAPGQGLEWMGWISTYSGNTKYAQKFQGRVTMTTDTSTSTVYMELRSLRSDDAAVYYCARDPPNDILTGYLDHWGQGTLVTVSS

SEQ ID NO: 2932 - protein, 15 aa, Artificial Sequence
  Description of Artificial Sequence: Synthetic peptide
ARDPPNDILTGYLDH

SEQ ID NO: 2933 - protein, 109 aa, Artificial Sequence
  Description of Artificial Sequence: Synthetic polypeptide
SYVLTQPPSVSAAPGKTAGITCGGDSIGGKSVHWYQQKPGQAPVLVVYDDSDRPSGIPERFSGSNSGNTATLTISRVEAGDEADYYCQVWDGSSDRHWVFGGGTKLTVL

SEQ ID NO: 2934 - protein, 12 aa, Artificial Sequence
  Description of Artificial Sequence: Synthetic peptide
QVWDGSSDRHWV

SEQ ID NO: 2935 - protein, 119 aa, Artificial Sequence
  Description of Artificial Sequence: Synthetic polypeptide
QVQLVQSGAEVKKPGASVKVSCKASGYTFSSHDINWVRQATGQGLEWVGWMNPNSGNTGSAQSFQGRVTLTRNASISTAYLELSSLRSEDTAVYFCARGFSLTWYFDLWGRGTLITVSS

SEQ ID NO: 2936 - protein, 12 aa, Artificial Sequence
  Description of Artificial Sequence: Synthetic peptide
ARGFSLTWYFDL

SEQ ID NO: 2937 - protein, 110 aa, Artificial Sequence
  Description of Artificial Sequence: Synthetic polypeptide
SYVLTQPPSVSAAPGKTARITCGGNNIGGKNVHWYQQKPGQAPVLVVFDDSDRPSGIPERFSGSNSGNTATLTISRVEAGDEADYYCQLWDSTSDHPDVVFGGGTQLTVL

SEQ ID NO: 2938 - protein, 13 aa, Artificial Sequence
  Description of Artificial Sequence: Synthetic peptide
QLWDSTSDHPDVV

SEQ ID NO: 2939 - protein, 119 aa, Artificial Sequence
  Description of Artificial Sequence: Synthetic polypeptide
QVQLVQSGAEVKKPGASVKVSCKASGYTFTSYSIHWMRQAPGQGLEWTGIINPSGGGTSYAKKFQGRVTMTRDTSTNTVYMELSSLRSEDTAVYYCAREGSLTGYFDLWGRGTLVTVSS

SEQ ID NO: 2940 - protein, 12 aa, Artificial Sequence
  Description of Artificial Sequence: Synthetic peptide
AREGSLTGYFDL

SEQ ID NO: 2941 - protein, 109 aa, Artificial Sequence
  Description of Artificial Sequence: Synthetic polypeptide
SYVLTQPPSVSVAPGKTARITCGGNNIGSKSVHWYQQKPGQAPILVVYDDSDRPSGIPERFSGSNSGNTATLTISRVEAGDEADYYCQVWDSSSDRHVVFGGGTKLTVL

SEQ ID NO: 2942 - protein, 12 aa, Artificial Sequence
  Description of Artificial Sequence: Synthetic peptide
QVWDSSSDRHVV

SEQ ID NO: 2943 - protein, 120 aa, Artificial Sequence
  Description of Artificial Sequence: Synthetic polypeptide
EVQLVESGGGLVKPGGSLRLSCAASGFTFSDYSMTWVRQAPGKGLEWVSFISSSSTYIYYADSVKGRFTISRDNAKSSLYLQMNRLRAEDTAVYYCTRVQVGARGWADYWGQGTLVTVSS

SEQ ID NO: 2944 - protein, 13 aa, Artificial Sequence
  Description of Artificial Sequence: Synthetic peptide
TRVQVGARGWADY

SEQ ID NO: 2945 - protein, 110 aa, Artificial Sequence; identical to SEQ ID NO: 136
  Description of Artificial Sequence: Synthetic polypeptide

SEQ ID NO: 2946 - protein, 9 aa, Artificial Sequence
  Description of Artificial Sequence: Synthetic peptide
QSCDTINWV

SEQ ID NO: 2947 - protein, 129 aa, Artificial Sequence; identical to SEQ ID NO: 107
  Description of Artificial Sequence: Synthetic polypeptide

SEQ ID NO: 2948 - protein, 22 aa, Artificial Sequence
  Description of Artificial Sequence: Synthetic peptide
ARGGRPDHETGIAVLGEYYFDS

SEQ ID NO: 2949 - protein, 106 aa, Artificial Sequence
  Description of Artificial Sequence: Synthetic polypeptide
SYVLTQPPSVSVSPGQTARITCSGDAFPLQYGYWYQQKPGQAPVLVIYKDKERPSGISERFSGSSSGTTVTLTISGVQAEDEADYYCQSADTNGVVFGGGTSLTVL

SEQ ID NO: 2950 - protein, 9 aa, Artificial Sequence
  Description of Artificial Sequence: Synthetic peptide
QSADTNGVV

SEQ ID NO: 2951 - protein, 124 aa, Artificial Sequence
  Description of Artificial Sequence: Synthetic polypeptide
QVQLVQSGAEVKKPGSSVKVSCKASGGTFSMSAISWVRQAPGQGLEWMGGIIPIFGTPNYAQKFQGRVTIAADESTSTAYMELSSLRSEDTAVYYCARDQNQIDPAYRDAFDIWGQGTMVTVSS

SEQ ID NO: 2952 - protein, 17 aa, Artificial Sequence
  Description of Artificial Sequence: Synthetic peptide
ARDQNQIDPAYRDAFDI

SEQ ID NO: 2953 - protein, 110 aa, Artificial Sequence
  Description of Artificial Sequence: Synthetic polypeptide
QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSSSWVFGGGTKLTVL

SEQ ID NO: 2954 - protein, 10 aa, Artificial Sequence
  Description of Artificial Sequence: Synthetic peptide
CSYAGSSSWV

SEQ ID NO: 2955 - protein, 118 aa, Artificial Sequence
  Description of Artificial Sequence: Synthetic polypeptide
QVQLQQWGAGLLKPSETLSLTCAVYGGSLSAYQWIWIRQSPGKGLEWIGEINHSGGSNCNPSLKTRVTMSVDTSKNQFSLRLSSVTAADTGVYYCARVQDLMYSLLYWGQGTLVIVSS

SEQ ID NO: 2956 - protein, 12 aa, Artificial Sequence
  Description of Artificial Sequence: Synthetic peptide
ARVQDLMYSLLY

SEQ ID NO: 2957 - protein, 110 aa, Artificial Sequence
  Description of Artificial Sequence: Synthetic polypeptide
SYVLTQPPSVSVAPGQTARITCGGNNIGSKNVHWYQQKPGQAPVLVVYDDSDRPSGIPERFSGSNSGNTATLSISRVEAGDEADYYCQVWDSTSDHPGVVFGGGTKLTVL

SEQ ID NO: 2958 - protein, 13 aa, Artificial Sequence
  Description of Artificial Sequence: Synthetic peptide
QVWDSTSDHPGVV

SEQ ID NO: 2959 - protein, 128 aa, Artificial Sequence
  Description of Artificial Sequence: Synthetic polypeptide
QVQLVQSGAEVKKSGASVKVSCKASGYSFTDYFMHWVRQAPGQGLEWMGWINPNSGGTNYAQKFQGRVTMTRDTSITTAYMELSRLRSDDTAVYYCARTPAPLRHVENYYYYYGLDVWGQGTTVTVSS

SEQ ID NO: 2960 - protein, 21 aa, Artificial Sequence
  Description of Artificial Sequence: Synthetic peptide
ARTPAPLRHVENYYYYYGLDV

SEQ ID NO: 2961 - protein, 111 aa, Artificial Sequence
  Description of Artificial Sequence: Synthetic polypeptide
QSVLTQPASVSGSPGQSITISCTGTASDVGGYNYVSWYQHHPGKAPTLMIYDVSNRPSGVSNRFSGSKSGNTASLTISGLQAEDEADYYCSSYTRGTTLVLFGGGTTLTVL

SEQ ID NO: 2962 - protein, 11 aa, Artificial Sequence
  Description of Artificial Sequence: Synthetic peptide
SSYTRGTTLVL

SEQ ID NO: 2963 - protein, 122 aa, Artificial Sequence
  Description of Artificial Sequence: Synthetic polypeptide
QVQLQESGPGLVKPSQTLSLTCTVSGGSISNGDYYWSWIRQHPGKGLEWIGYIYHSGITYYNPSLKSRLMISIDTSKNQFSLKLRSVTAADTAVYYCARFLRNFEWLFFDPWGQGTLVTVSS

SEQ ID NO: 2964 - protein, 14 aa, Artificial Sequence
  Description of Artificial Sequence: Synthetic peptide
ARFLRNFEWLFFDP

SEQ ID NO: 2965 - protein, 109 aa, Artificial Sequence
  Description of Artificial Sequence: Synthetic polypeptide
QSVLTQPPSASGSPGQSVTISCTGTSSDVGGYDYVSWYQHHPGKAPKVMIYEVRKRPSGVPDRFSGSKSGNTASLTVSGLQAEDEADYYCSSYVGSNVLFGGGTKLTVL

SEQ ID NO: 2966 - protein, 9 aa, Artificial Sequence
  Description of Artificial Sequence: Synthetic peptide
SSYVGSNVL

SEQ ID NO: 2967 - protein, 123 aa, Artificial Sequence; identical to SEQ ID NO: 93
  Description of Artificial Sequence: Synthetic polypeptide

SEQ ID NO: 2968 - protein, 17 aa, Artificial Sequence
  Description of Artificial Sequence: Synthetic peptide
ARGWPYCGVDCYSGFDY

SEQ ID NO: 2969 - protein, 111 aa, Artificial Sequence; identical to SEQ ID NO: 94
  Description of Artificial Sequence: Synthetic polypeptide

SEQ ID NO: 2970 - protein, 12 aa, Artificial Sequence
  Description of Artificial Sequence: Synthetic peptide
AAWDDSLNGLWV

SEQ ID NO: 2971 - protein, 124 aa, Artificial Sequence
  Description of Artificial Sequence: Synthetic polypeptide
QVQLVQSGAEVKKPGASVKVSCEASGFPFINYFMHWVRQAPGQGLEWMGVINPGGGSTTYPQKFQGRVTMTRDTSTSTVYMELSSLRSEDTAVYYCARGRSRGVGDVYPSVDYWGQGTLVTVSS

SEQ ID NO: 2972 - protein, 17 aa, Artificial Sequence
  Description of Artificial Sequence: Synthetic peptide
ARGRSRGVGDVYPSVDY

SEQ ID NO: 2973 - protein, 110 aa, Artificial Sequence
  Description of Artificial Sequence: Synthetic polypeptide
QSVLTQPPSASGTPGQRVTISCSGNSSNIGSNTVSWSQQLPGTAPKLLIYSNHQRPSGVPDRFSGSKSGTSASLAISGLQSEDEADYHCAAWDDSLNGPVFGGGTQLTVL

SEQ ID NO: 2974 - protein, 11 aa, Artificial Sequence
  Description of Artificial Sequence: Synthetic peptide
AAWDDSLNGPV

SEQ ID NO: 2975 - protein, 122 aa, Artificial Sequence; identical to SEQ ID NO: 123
  Description of Artificial Sequence: Synthetic polypeptide

SEQ ID NO: 2976 - protein, 14 aa, Artificial Sequence
  Description of Artificial Sequence: Synthetic peptide
ARQHRYGSGSSELL

SEQ ID NO: 2977 - protein, 110 aa, Artificial Sequence
  Description of Artificial Sequence: Synthetic polypeptide
QSVLTQPPSASGSPGQSVTISCTGTSSDVGSYNYVSWYQQHPGKAPKLMIYEVTKRPSGVPDRFSGSKSGNTASLTVSGLQADDEADYYCSSYAGSSNLIFGGGTKLTVL

SEQ ID NO: 2978 - protein, 10 aa, Artificial Sequence
  Description of Artificial Sequence: Synthetic peptide
SSYAGSSNLI

SEQ ID NO: 2979 - protein, 120 aa, Artificial Sequence
  Description of Artificial Sequence: Synthetic polypeptide
EVQLVQSGAEVKKAGEPLKISCRASGYTFTRYWIGWVRQMPGKGLEWMGIIYPHDSDTRYSPSFEGQVTISADKSISTAYLQWSRLKASDTAVYYCARRGGDYPPWFDPWGQGTLVTVSS

SEQ ID NO: 2980 - protein, 13 aa, Artificial Sequence
  Description of Artificial Sequence: Synthetic peptide
ARRGGDYPPWFDP

SEQ ID NO: 2981 - protein, 110 aa, Artificial Sequence
  Description of Artificial Sequence: Synthetic polypeptide
QSVLTQPRSVSGSPGQSVTISCTGTSSDFGAYTYVSWYQQRPGKAPKLMIYDVIKRPSGVPDRFSGSKSGNTASLTISGLQADDEADYYCCSYADSYTVIFGGGTKLTVL

SEQ ID NO: 2982 - protein, 10 aa, Artificial Sequence
  Description of Artificial Sequence: Synthetic peptide
CSYADSYTVI

SEQ ID NO: 2983 - protein, 122 aa, Artificial Sequence
  Description of Artificial Sequence: Synthetic polypeptide
QLQLQESGPGLVKPSETLSLTCTVSGGSITTSSYYWGWIRQPPGKGLEWIGAIYYTGITYYNPSLKSRVTMSVDTSKNQFALRLSSVTAADTAVYYCARQNRFGSGSSELLWGQGTLVTVSS

SEQ ID NO: 2984 - protein, 14 aa, Artificial Sequence
  Description of Artificial Sequence: Synthetic peptide
ARQNRFGSGSSELL

SEQ ID NO: 2985 - protein, 110 aa, Artificial Sequence
  Description of Artificial Sequence: Synthetic polypeptide
QSVLTQPPSASGSPGQSVTISCTGTSSDVGSYDYVSWYQQHPGKAPKLVIYEVSERPSGVPDRFSGSKSGNTATLTVSGLQADDEADYYCSSYAGSNNLIFGGGTKLTVL

SEQ ID NO: 2986 - protein, 10 aa, Artificial Sequence
  Description of Artificial Sequence: Synthetic peptide
SSYAGSNNLI

SEQ ID NO: 2987 - protein, 132 aa, Artificial Sequence
  Description of Artificial Sequence: Synthetic polypeptide
QVQLVQSGAEVKKPGASVKVSCKASGYTFTDYYLHWVRQAPGQGLEWVGWINPISGGTNYAQQFQGRVSMTRHTSITTAYMELSRLRSDDTAVYYCARVYHLLLGEGSWSPLPYYYYGMDVWGQGTTVTVSS

SEQ ID NO: 2988 - protein, 25 aa, Artificial Sequence
  Description of Artificial Sequence: Synthetic peptide
ARVYHLLLGEGSWSPLPYYYYGMDV

SEQ ID NO: 2989 - protein, 110 aa, Artificial Sequence
  Description of Artificial Sequence: Synthetic polypeptide
QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSNTFVFGTGTKVTVL

SEQ ID NO: 2990 - protein, 10 aa, Artificial Sequence
  Description of Artificial Sequence: Synthetic peptide
CSYAGSNTFV

SEQ ID NO: 2991 - protein, 129 aa, Artificial Sequence
  Description of Artificial Sequence: Synthetic polypeptide
EVQLVESGGGLVKPGRSLRLSCTVSGFTFGAYAMSWFRQAPGKGLEWVGFIRSKTYGGTTEYAASLKGRFTISRDDSKSIAFLQMNSLKTEDTAVYFCSRGGYYDGSPYYWNRPDAFDIWGLGTVVTVS

SEQ ID NO: 2992 - protein, 21 aa, Artificial Sequence
  Description of Artificial Sequence: Synthetic peptide
SRGGYYDGSPYYWNRPDAFDI

SEQ ID NO: 2993 - protein, 112 aa, Artificial Sequence; identical to SEQ ID NO: 120
  Description of Artificial Sequence: Synthetic polypeptide

SEQ ID NO: 2994 - protein, 13 aa, Artificial Sequence
  Description of Artificial Sequence: Synthetic peptide
AAWDDSLNGPDVV

SEQ ID NO: 2995 - protein, 130 aa, Artificial Sequence
  Description of Artificial Sequence: Synthetic polypeptide
EVQLVESGGGLVKPGRSLRLSCTASGFTFGDYAMSWFRQAPGKGLEWVGFIRSKSYGGTTEYAASVKGRFTISRDDSKSIDYLQMNSLKTEDTAVYYCTRGGYYDGSGFYWNRPDAFDIWGQGTMVTVSS

SEQ ID NO: 2996 - protein, 21 aa, Artificial Sequence
  Description of Artificial Sequence: Synthetic peptide
TRGGYYDGSGFYWNRPDAFDI

SEQ ID NO: 2997 - protein, 112 aa, Artificial Sequence
  Description of Artificial Sequence: Synthetic polypeptide
QSVLTQPPSASGTPGQRVTISCSGSSSNIGSNTVNWYQQLPGAAPKLLIYFNNQRPSGVPDRFSGSRSGTSASLAISGLQSEDEADYYCAAWDDSLNGPDVVFGGGTKLTVL

SEQ ID NO: 2998 - protein, 13 aa, Artificial Sequence
  Description of Artificial Sequence: Synthetic peptide
AAWDDSLNGPDVV

SEQ ID NO: 2999 - protein, 122 aa, Artificial Sequence
  Description of Artificial Sequence: Synthetic polypeptide
QLQLQESGPGLVKPSETLSLTCTVSGGSISNNNYYWAWIRQPPGKGLEWIGNIYYTGITYYNPSLKSRVAISVDMSMNQFSLKLRSVTAADTAVYFCARQNRYGSGSSELLWGQGTLVTVSS

SEQ ID NO: 3000 - protein, 14 aa, Artificial Sequence
  Description of Artificial Sequence: Synthetic peptide
ARQNRYGSGSSELL

SEQ ID NO: 3001 - protein, 110 aa, Artificial Sequence
  Description of Artificial Sequence: Synthetic polypeptide
QSVLTQPPSASGSPGQSVTISCTGTSSDVGSYNYVSWYQQHPGKAPKLLIYEVTQRPSGVPDRFSGSKSGNTASLTVSGLQTEDEADYYCSSYAGSNSLVFGGGTKLTVL

SEQ ID NO: 3002 - protein, 10 aa, Artificial Sequence
  Description of Artificial Sequence: Synthetic peptide
SSYAGSNSLV

SEQ ID NO: 3003 - protein, 126 aa, Artificial Sequence
  Description of Artificial Sequence: Synthetic polypeptide
QVQLVQSGAEVKKPGSSVRVSCKASGGTFSRDALSWVRQAPGQGLEWMGGIIPISDSATYAQKFQGRVTLIADEATATAYMELSSLRSEDTAVYYCARHMVVIPVGLHYYYGMDVWGQGTTVTVSS

SEQ ID NO: 3004 - protein, 19 aa, Artificial Sequence
  Description of Artificial Sequence: Synthetic peptide
ARHMVVIPVGLHYYYGMDV

SEQ ID NO: 3005 - protein, 111 aa, Artificial Sequence
  Description of Artificial Sequence: Synthetic polypeptide
QSVLTQPPSVSGAPGQRVTISCTGSGSNIGAGFDVHWYQQLPGTAPKLLIYGNSNRPSGVPDRFSGSKSGTSASLAITGLQAEDEADYYCQSYDSGLSASVFGGGTKLTVL

SEQ ID NO: 3006 - protein, 11 aa, Artificial Sequence
  Description of Artificial Sequence: Synthetic peptide
QSYDSGLSASV

SEQ ID NO: 3007 - protein, 124 aa, Artificial Sequence
  Description of Artificial Sequence: Synthetic polypeptide
QVQLVQSGAEVKKPGSSVKVSCKASGGTFSSYSISWVRQAPGQGLEWMGGIMPILGIANYAQWFQGRVTITADESTSTAYMELSSLRSEDTAVYYCARERGYSDYGSVQYFDYWGQGTLVTVSS

SEQ ID NO: 3008 - protein, 17 aa, Artificial Sequence
  Description of Artificial Sequence: Synthetic peptide
ARERGYSDYGSVQYFDY

SEQ ID NO: 3009 - protein, 114 aa, Artificial Sequence
  Description of Artificial Sequence: Synthetic polypeptide
QSVLTQPPSVSGAPGQRVTISCTGSNSNIGAGYDVHWYQQLPGTAPKLLIYADINRPSGVPDRFSGSKSDTSASASLAITGLQAEDEADYYCQSYDSSLSGSVVFGGGTKLTVL

SEQ ID NO: 3010 - protein, 12 aa, Artificial Sequence
  Description of Artificial Sequence: Synthetic peptide
QSYDSSLSGSVV

SEQ ID NO: 3011 - protein, 126 aa, Artificial Sequence; identical to SEQ ID NO: 99
  Description of Artificial Sequence: Synthetic polypeptide

SEQ ID NO: 3012 - protein, 19 aa, Artificial Sequence
  Description of Artificial Sequence: Synthetic peptide
ARGGYCGSTSCSPDDYFDY

SEQ ID NO: 3013 - protein, 109 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYYVFGTGTKVTVL

SEQ ID NO: 3014 - protein, 12 aa, Artificial Sequence
  Description of Artificial Sequence: Synthetic peptide
QVWDSSSDHYYV

SEQ ID NO: 3015 - protein, 124 aa, Artificial Sequence
  Description of Artificial Sequence: Synthetic polypeptide
QVQLVESGGGVVQPGRSLRLSCAASGFIFSSYGMHWVRQAPGKGLEWVAGIWYDGSNKFYADSVKGRFTISRDNSKNTLYLQMNSLRAEDTAVYFCARDGAVAPAGSLDWFDPWGQGTLVTVSS

SEQ ID NO: 3016 - protein, 17 aa, Artificial Sequence
  Description of Artificial Sequence: Synthetic peptide
ARDGAVAPAGSLDWFDP

SEQ ID NO: 3017 - protein, 108 aa, Artificial Sequence
  Description of Artificial Sequence: Synthetic polypeptide
SYVLTQPPSVSVAPGKTARITCGGNYIGSKSVHWYQQKPGQAPVLVIYYDTDRPSGIPERFSGSNSGNTATLTISRVEAGDEADYYCQVWDSSGDHYVFGTGTKVTVL

SEQ ID NO: 3018 - protein, 11 aa, Artificial Sequence
  Description of Artificial Sequence: Synthetic peptide
QVWDSSGDHYV

SEQ ID NO: 3019 - protein, 120 aa, Artificial Sequence
  Description of Artificial Sequence: Synthetic polypeptide
QLQLQESGPGLVRPSETLSLTCTVSGGSISSSSYYWGWIRQPPGKGLEWIGDMYYSGSTYYTPSLRGRVTISVDTSKNQFSLKLSSVTAADTAVYYCASRGWLRGAFDVWGQGTVATVSS

SEQ ID NO: 3020 - protein, 12 aa, Artificial Sequence
  Description of Artificial Sequence: Synthetic peptide
ASRGWLRGAFDV

SEQ ID NO: 3021 - protein, 111 aa, Artificial Sequence
  Description of Artificial Sequence: Synthetic polypeptide
NFMLTQPHSVSESPGKTVTISCTHSSGSIASNYVQWYQQRPGSSPTIVIFEDNQRPSGVPDRFSGSIDSSSNSASLTISGLKTEDEADYYCQSYDSSIHVVFGGGTKLTVL

SEQ ID NO: 3022 - protein, 10 aa, Artificial Sequence
  Description of Artificial Sequence: Synthetic peptide
QSYDSSIHVV

SEQ ID NO: 3023 - protein, 123 aa, Artificial Sequence
  Description of Artificial Sequence: Synthetic polypeptide
EVQLVESGGGLVQPGRSLRLSCAASGFTFDDYGMHWVRQAPGKGLEWVSGISWNGDSIGYADSVKGRFTISRDNAKTSLYLQMNRLRAEDTALYYCAKAASRSTRIGGAFDIWGQGTMVTVSS

SEQ ID NO: 3024 - protein, 16 aa, Artificial Sequence
  Description of Artificial Sequence: Synthetic peptide
AKAASRSTRIGGAFDI

SEQ ID NO: 3025 - protein, 109 aa, Artificial Sequence
  Description of Artificial Sequence: Synthetic polypeptide
QSVLTQPASVSGSPGQSITISCTGTSSDVGGYNLVSWYQQHPGKAPKLMIYEGSKRPSGVSNRFSGSKSGNTASLTISGLQAEDEADYYCCSYAYSFTNVFGTGTKVTV

SEQ ID NO: 3026 - protein, 10 aa, Artificial Sequence
  Description of Artificial Sequence: Synthetic peptide
CSYAYSFTNV

SEQ ID NO: 3027 - protein, 122 aa, Artificial Sequence; identical to SEQ ID NO: 95
  Description of Artificial Sequence: Synthetic polypeptide

SEQ ID NO: 3028 - protein, 16 aa, Artificial Sequence
  Description of Artificial Sequence: Synthetic peptide
AKTPRGDYDSSGTSAY

SEQ ID NO: 3029 - protein, 112 aa, Artificial Sequence
  Description of Artificial Sequence: Synthetic polypeptide
QSVLTQSPSASASLGASVNLTCTLSSGHSSYAIAWHQQQPEKGPRFLMKLSSDGSHNKGDGIPDRFSGSSSGAERFLTISSLQSEDEADYYCQTWGIGSDWVFGGGTKLTVL

SEQ ID NO: 3030 - protein, 10 aa, Artificial Sequence
  Description of Artificial Sequence: Synthetic peptide
QTWGIGSDWV

SEQ ID NO: 3031 - protein, 123 aa, Artificial Sequence; identical to SEQ ID NO: 153
  Description of Artificial Sequence: Synthetic polypeptide

SEQ ID NO: 3032 - protein, 14 aa, Artificial Sequence
  Description of Artificial Sequence: Synthetic peptide
TTDDPGSYYYGMDV

SEQ ID NO: 3033 - protein, 109 aa, Artificial Sequence
  Description of Artificial Sequence: Synthetic polypeptide
QSVLTQEPSLTVSPGGTVTLTCASSTGAVTSGHYPYWFQQKPGQAPRTLIYATSNKHSWTPARFSGSLLGGKAALTLSGAQPEDEADYYCLLSYSGARVFGGGTKLTVL

SEQ ID NO: 3034 - protein, 9 aa, Artificial Sequence
  Description of Artificial Sequence: Synthetic peptide
LLSYSGARV

SEQ ID NO: 3035 - protein, 129 aa, Artificial Sequence
  Description of Artificial Sequence: Synthetic polypeptide
EVQLVESGGGLVQPGRSLRVSCAASGFTFDDYAMHWVRQAPGKGLEWVSGISWNSGSKAYADSVKGRFTISRDNAKNSLHLQMNSLRAEDKALYYCAKDVSKTGWFGEIANREYYFDYWGQGTLVTVSA

SEQ ID NO: 3036 - protein, 22 aa, Artificial Sequence
  Description of Artificial Sequence: Synthetic peptide
AKDVSKTGWFGEIANREYYFDY

SEQ ID NO: 3037 - protein, 106 aa, Artificial Sequence
  Description of Artificial Sequence: Synthetic polypeptide
SYVLTQPPSVSVSPGQTARITCSGDALPNQYVYWYQQKPGQAPLLVIYKDTERPSGIPERFSGSTSGTTVTLTISGVQAEDEADYYCQLADSSGVVFGGGTKLTVL

SEQ ID NO: 3038 - protein, 9 aa, Artificial Sequence
  Description of Artificial Sequence: Synthetic peptide
QLADSSGVV

SEQ ID NO: 3039 - protein, 130 aa, Artificial Sequence; identical to SEQ ID NO: 165
  Description of Artificial Sequence: Synthetic polypeptide

SEQ ID NO: 3040 - protein, 23 aa, Artificial Sequence
  Description of Artificial Sequence: Synthetic peptide
AKIADLVGAYDFRSGQHFAAFDV

SEQ ID NO: 3041 - protein, 108 aa, Artificial Sequence; identical to SEQ ID NO: 166
  Description of Artificial Sequence: Synthetic polypeptide

SEQ ID NO: 3042 - protein, 9 aa, Artificial Sequence
  Description of Artificial Sequence: Synthetic peptide
ASWDDSLVV

SEQ ID NO: 3043 - protein, 122 aa, Artificial Sequence
  Description of Artificial Sequence: Synthetic polypeptide
QVQLQESGPGLVKPSQTLSLNCSVSGGSISSGNYYWSWIRQPAGKGLEWIGHILTRGSTNYNPSLKSRVTISVDTSGNQFSLKLSPVTAADTAVYYCARTDYDILTGYYVYWGQGTLVTVSS

SEQ ID NO: 3044 - protein, 14 aa, Artificial Sequence
  Description of Artificial Sequence: Synthetic peptide
ARTDYDILTGYYVY

SEQ ID NO: 3045 - protein, 109 aa, Artificial Sequence
  Description of Artificial Sequence: Synthetic polypeptide
SYVLTQPPSVSVAPGKTARITCGESNIGSKSVHWYQRKPGQAPVLVVYDDSDRPSGIPERFSGSNSGNTATLTISRVEVGDEADYYCQVWDGSSDHFYVFGTGTKVTVL

SEQ ID NO: 3046 - protein, 12 aa, Artificial Sequence
  Description of Artificial Sequence: Synthetic peptide
QVWDGSSDHFYV

SEQ ID NO: 3047 - protein, 118 aa, Artificial Sequence
  Description of Artificial Sequence: Synthetic polypeptide
EVQLVESGGGLIQPGGSLRLSCAASGFTVSSNYMTWVRQAPGKGLEWVSVVYSGDNTYYADSVKGRFTTSRDNSKNTVFLQMNSLKAEDTALYYCARTQWLRGSFDLWGRGTLVTVSS

SEQ ID NO: 3048 - protein, 12 aa, Artificial Sequence
  Description of Artificial Sequence: Synthetic peptide
ARTQWLRGSFDL

SEQ ID NO: 3049 - protein, 111 aa, Artificial Sequence
  Description of Artificial Sequence: Synthetic polypeptide
NFMLTQPHSVSESPGKTVTISCTHSSGSIASNYVQWYQQRPGSSPIIVIYEDNQRPSGVPDRFSGSIDSSSNSASLTISGLKTEDEADYYCQSYDVSNHWVFGGGTRLTVL

SEQ ID NO: 3050 - protein, 10 aa, Artificial Sequence
  Description of Artificial Sequence: Synthetic peptide
QSYDVSNHWV

SEQ ID NO: 3051 - protein, 130 aa, Artificial Sequence
  Description of Artificial Sequence: Synthetic polypeptide
EVQLVESGGGLVQPGRSLKLSCAASGFTFEDYAMHWVRQAPGKGLEWVSGSTWNSGTIGYADSVKGRFTISRDNAKNSLYLQMNRLRAEDTALYYCVKDLYYLGKRRSSVIFEVYGMDVWGQGTAVTVSS

SEQ ID NO: 3052 - protein, 23 aa, Artificial Sequence
  Description of Artificial Sequence: Synthetic peptide
VKDLYYLGKRRSSVIFEVYGMDV

SEQ ID NO: 3053 - protein, 108 aa, Artificial Sequence
  Description of Artificial Sequence: Synthetic polypeptide
SYVLTQPPSVSVAPGKTARLTCGGNNIGSKGVHWYQQKPGQAPVLVVYDDSDRPSGLPERFSGSNSGNTASLTISRVEAGDEADYYCQVWDSNSDLVVFGGGTKLTVL

SEQ ID NO: 3054 - protein, 11 aa, Artificial Sequence
  Description of Artificial Sequence: Synthetic peptide
QVWDSNSDLVV

SEQ ID NO: 3055 - protein, 122 aa, Artificial Sequence
  Description of Artificial Sequence: Synthetic polypeptide
QVQLQESGPGLVKPSQTLSLTCTVSGGSITSGRYYWSWIRQPAGKGLEWIGHIFTSGSTNYNPSLKSRITISVDRSKNQFSLRLSSATAADTAVYFCARGDYESLTGYYDYWGQGTLVTVSS

SEQ ID NO: 3056 - protein, 14 aa, Artificial Sequence
  Description of Artificial Sequence: Synthetic peptide
ARGDYESLTGYYDY

SEQ ID NO: 3057 - protein, 109 aa, Artificial Sequence
  Description of Artificial Sequence: Synthetic polypeptide
SYVLTQPPSVSVAPGKTARITCEENDIGSKNVHWYQQKPGQAPVLVVYDDSDRPSGIPERFSGSNSGNTATLTISRVEAGDEADYYCQVWDGSSDHFYVFGTGTKVTVL

SEQ ID NO: 3058 - protein, 12 aa, Artificial Sequence
  Description of Artificial Sequence: Synthetic peptide
QVWDGSSDHFYV

SEQ ID NO: 3059 - protein, 120 aa, Artificial Sequence
  Description of Artificial Sequence: Synthetic polypeptide
QVQLQESGPGLVKPSQTLSLTCTVSGGSISSGNYYLTWIRQPAGKGLEWIGHIYTSGSTNYNPSLKSRVTISVDTSMNQFSLKLSSVTAADTAVYYCARDIPPTWYFDLWGRGTLVTVSS

SEQ ID NO: 3060 - protein, 12 aa, Artificial Sequence
  Description of Artificial Sequence: Synthetic peptide
ARDIPPTWYFDL

SEQ ID NO: 3061 - protein, 110 aa, Artificial Sequence
  Description of Artificial Sequence: Synthetic polypeptide
SYVLTQPPSVSVAPGKTARITCGGNNIGSKNVHWYQQKPGQAPVLVVYDDSDRPSGIPERFSGSNSGNTATLTISRVEAGDEAGYYCQVWDSTSDHLFWVFGGGTKLTVL

SEQ ID NO: 3062 - protein, 13 aa, Artificial Sequence
  Description of Artificial Sequence: Synthetic peptide
QVWDSTSDHLFWV

SEQ ID NO: 3063 - protein, 130 aa, Artificial Sequence
  Description of Artificial Sequence: Synthetic polypeptide
QLQLQESGPGLVKPSETLSLTCTVSGGSITSSSYYWGWIRQPPGKGLEWIGTIYYGGSTYYNPSLKSRVTISVDTSKNQISLKLSSVTAADTAVYYCASLRGAYYDFWSGPRDGGWFDPWGQGTLVTVSS

SEQ ID NO: 3064 - protein, 22 aa, Artificial Sequence
  Description of Artificial Sequence: Synthetic peptide
ASLRGAYYDFWSGPRDGGWFDP

SEQ ID NO: 3065 - protein, 110 aa, Artificial Sequence
  Description of Artificial Sequence: Synthetic polypeptide
  MOD_RES (2)..(4): Any amino acid
QXXXTQPASVSGSPGQSITISCTGTSSDVGSYNLVSWYQQHPGKAPKLMIYEDSKRPSGVSNRFSGSKSGNTASLTISGLQAEDEADYYCCSYAGSSLWVFGGGTKLTVL

SEQ ID NO: 3066 - protein, 10 aa, Artificial Sequence
  Description of Artificial Sequence: Synthetic peptide
CSYAGSSLWV

SEQ ID NO: 3067 - protein, 120 aa, Artificial Sequence; identical to SEQ ID NO: 175
  Description of Artificial Sequence: Synthetic polypeptide

SEQ ID NO: 3068 - protein, 13 aa, Artificial Sequence
  Description of Artificial Sequence: Synthetic peptide
ARVQVGARGWVDY

SEQ ID NO: 3069 - protein, 110 aa, Artificial Sequence; identical to SEQ ID NO: 176
  Description of Artificial Sequence: Synthetic polypeptide

SEQ ID NO: 3070 - protein, 9 aa, Artificial Sequence
  Description of Artificial Sequence: Synthetic peptide
QSYDSINWV

SEQ ID NO: 3071 - protein, 122 aa, Artificial Sequence
  Description of Artificial Sequence: Synthetic polypeptide
QVQLVQSGAEVKKPGASVRVSCKASGYTFTGYYIHWVRQAPGQGLEWMGWINPMSGGTNYTQKFQGWVTMTRDTSINTAYMELSRLRSDDTAVYYCARDFAMGTVTGTFVYWGQGTLVTVSS

SEQ ID NO: 3072 - protein, 15 aa, Artificial Sequence
  Description of Artificial Sequence: Synthetic peptide
ARDFAMGTVTGTFVY

SEQ ID NO: 3073 - protein, 110 aa, Artificial Sequence
  Description of Artificial Sequence: Synthetic polypeptide
  MOD_RES (2)..(3): Any amino acid
QXXLTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGTGTKVTVL

SEQ ID NO: 3074 - protein, 10 aa, Artificial Sequence
  Description of Artificial Sequence: Synthetic peptide
SSYAGSNNWV

SEQ ID NO: 3075 - protein, 120 aa, Artificial Sequence; identical to SEQ ID NO: 173
  Description of Artificial Sequence: Synthetic polypeptide

SEQ ID NO: 3076 - protein, 13 aa, Artificial Sequence
  Description of Artificial Sequence: Synthetic peptide
ARVQVGARGWVDY

SEQ ID NO: 3077 - protein, 110 aa, Artificial Sequence; identical to SEQ ID NO: 174
  Description of Artificial Sequence: Synthetic polypeptide

SEQ ID NO: 3078 - protein, 9 aa, Artificial Sequence
  Description of Artificial Sequence: Synthetic peptide
QSYDRINWV

SEQ ID NO: 3079 - protein, 120 aa, Artificial Sequence
  Description of Artificial Sequence: Synthetic polypeptide
QVQLVQSGAEVKKPGASVKVSCKASGYTVTGYYIHWVRQAPGQGLEWMGWISPNSGGTNYAQKFQGWVTMTRDMSITTAYMELSRLRSDDTAVYYCARERYFDLGGMDVWGQGTTVTVSS

SEQ ID NO: 3080 - protein, 13 aa, Artificial Sequence
  Description of Artificial Sequence: Synthetic peptide
ARERYFDLGGMDV

SEQ ID NO: 3081 - protein, 110 aa, Artificial Sequence
  Description of Artificial Sequence: Synthetic polypeptide
QSALTQPASVSGSPGQSITISCTGTSSDVGSYNLVSWYQQHPGKAPKLMIYEDSKRPSGVSNRFSGSKSGNTASLTISGLQAEDEADYYCCSYAGSSTRLFGGGTKLTVL

SEQ ID NO: 3082 - protein, 10 aa, Artificial Sequence
  Description of Artificial Sequence: Synthetic peptide
CSYAGSSTRL

SEQ ID NO: 3083 - protein, 118 aa, Artificial Sequence
  Description of Artificial Sequence: Synthetic polypeptide
EVQLVESGGGLIQPGGSLRLSCAASGFTVSSNYMSWVRQAPGKGLEWVSVISSGGGTFYADSVKGRFTISRDNSKNTLYLQMNSLRAEDTAVYYCARSLWLRGSFQHWGQGTLVTVSS

SEQ ID NO: 3084 - protein, 12 aa, Artificial Sequence
  Description of Artificial Sequence: Synthetic peptide
ARSLWLRGSFQH

SEQ ID NO: 3085 - protein, 110 aa, Artificial Sequence
  Description of Artificial Sequence: Synthetic polypeptide
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSSWVFGGGTKLTVL

SEQ ID NO: 3086 - protein, 9 aa, Artificial Sequence
  Description of Artificial Sequence: Synthetic peptide
QSYDSSSWV

SEQ ID NO: 3087 - protein, 121 aa, Artificial Sequence
  Description of Artificial Sequence: Synthetic polypeptide
EVQLVESGGGLVQPGRSLRLSCAASGFTFDDYAMHWVRQVPGKGLEWVSGISWNSASIGYADSVKGRFTISRDNAKNSLYLQMNSLRPEDMAFYYCAKGSSSGWTRPLDYWGQGTLVTVSS

SEQ ID NO: 3088 - protein, 14 aa, Artificial Sequence
  Description of Artificial Sequence: Synthetic peptide
AKGSSSGWTRPLDY

SEQ ID NO: 3089 - protein, 108 aa, Artificial Sequence
  Description of Artificial Sequence: Synthetic polypeptide
  MOD_RES (3)..(3): Any amino acid
SYXLTQPPSVSVAPGKTARITCGGNNIGSKSVHWYQQKPGQAPVLVVYDDSDRPSGIPERFSGSNSGNTATLTISRVEAGDEADYYCQVWDSSSDPVVFGGGTKLTVL

SEQ ID NO: 3090 - protein, 11 aa, Artificial Sequence
  Description of Artificial Sequence: Synthetic peptide
QVWDSSSDPVV

SEQ ID NO: 3091 - protein, 126 aa, Artificial Sequence; identical to SEQ ID NO: 141
  Description of Artificial Sequence: Synthetic polypeptide

SEQ ID NO: 3092 - protein, 19 aa, Artificial Sequence
  Description of Artificial Sequence: Synthetic peptide
ARREAYGPRDYYYYYGMDV

SEQ ID NO: 3093 - protein, 116 aa, Artificial Sequence
  Description of Artificial Sequence: Synthetic polypeptide
  MOD_RES (3)..(4): Any amino acid
QSXXTQPPSASASLGASVTLTCTLSSGYSNYKVDWYQQRPGKGPRFVMRVGTGGIVGSKGDGIPDRFSVLGSGLNRYLTIKNIQEEDESDYHCGADQGSGSNFVGVFGGGTKLTVL

SEQ ID NO: 3094 - protein, 13 aa, Artificial Sequence
  Description of Artificial Sequence: Synthetic peptide
GADQGSGSNFVGV

SEQ ID NO: 3095 - protein, 119 aa, Artificial Sequence
  Description of Artificial Sequence: Synthetic polypeptide
QVQLVQSGAEVKKSGASVKVSCKASGYTFTSYDINWVRQATGQGLEWMGWMNPNSGNTGYAQKFQGRVTMTRNTSISTAYMDLSSLRSEDTAVYYCARGFSLTWYFDLWGRGTLVTVSS

SEQ ID NO: 3096 - protein, 12 aa, Artificial Sequence
  Description of Artificial Sequence: Synthetic peptide
ARGFSLTWYFDL

SEQ ID NO: 3097 - protein, 110 aa, Artificial Sequence
  Description of Artificial Sequence: Synthetic polypeptide
  MOD_RES (3)..(3): Any amino acid
SYXLTQPPSVSVAPGKTARITCGGNNIGSKSVHWYQQKPGHAPVLVVYDDSDRPSGIPERFSGSNSGNTATLTISRVEAGDEADYYCQVWDSTGGHPDVVFGGGTKLTVL

SEQ ID NO: 3098 - protein, 13 aa, Artificial Sequence
  Description of Artificial Sequence: Synthetic peptide
QVWDSTGGHPDVV

SEQ ID NO: 3099 - protein, 119 aa, Artificial Sequence
  Description of Artificial Sequence: Synthetic polypeptide
EVQLVESGGGLVQPGGSLRLSCAASRFTFSSYWMSWVRQAPGKGLEWVANIKQDGSEKYYVDSVKGRFTISRDNAKNSLYLQMNSLRAEDTAVYYCATAPWLRGGFDYWGQGTLVTVSS

SEQ ID NO: 3100 - protein, 12 aa, Artificial Sequence
  Description of Artificial Sequence: Synthetic peptide
ATAPWLRGGFDY

SEQ ID NO: 3101 - protein, 111 aa, Artificial Sequence
  Description of Artificial Sequence: Synthetic polypeptide
NFMLTQPHSVSESPGKTVTISCTRSSGSIASNYVQWYQQRPGSSPTTVIYEDSQRPSGVPDRFSGSIDSSSNSASLTISGLKTEDEADYYCQSFDSTNLWVFGGGTKLTVL

SEQ ID NO: 3102 - protein, 10 aa, Artificial Sequence
  Description of Artificial Sequence: Synthetic peptide
QSFDSTNLWV

SEQ ID NO: 3103 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGGYSYGYSLYYFDYWGQGTLVTVSS

SEQ ID NO: 3104 - protein, 16 aa, Artificial Sequence
  Description of Artificial Sequence: Synthetic peptide
AKGGYSYGYSLYYFDY

SEQ ID NO: 3105 - protein, 110 aa, Artificial Sequence
  Description of Artificial Sequence: Synthetic polypeptide
  MOD_RES (2)..(4): Any amino acid
QXXXTQPASVSGSPGQSITISCTGTSSDVGGYNYVSWHQQHPGKAPKLMIYDVSNRPSGVSNRFSGSKSGNTASLTISGLQAEDEADYYCSSYTSSSTLVFGGGTKLTVL

SEQ ID NO: 3106 - protein, 10 aa, Artificial Sequence
  Description of Artificial Sequence: Synthetic peptide
SSYTSSSTLV

SEQ ID NO: 3107 - protein, 127 aa, Artificial Sequence
  Description of Artificial Sequence: Synthetic polypeptide
  MOD_RES (88)..(88): Any amino acid
QVQLVQSGAEVKKPGASVKVSCKASGYTFTSYDINWVRQATGQGLEWMGWMNPNSGNTGYAQKFQGRVTITRDTSISTAYMELSSLRXEDTAVYYCARGGRYCSDVSCYSGTGFDYWGQGTLVTVSS

SEQ ID NO: 3108 - protein, 20 aa, Artificial Sequence
  Description of Artificial Sequence: Synthetic peptide
ARGGRYCSDVSCYSGTGFDY

SEQ ID NO: 3109 - protein, 111 aa, Artificial Sequence; identical to SEQ ID NO: 697
  Description of Artificial Sequence: Synthetic polypeptide

SEQ ID NO: 3110 - protein, 12 aa, Artificial Sequence
  Description of Artificial Sequence: Synthetic peptide
AAWDDSLSGYWV

SEQ ID NO: 3111 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKAQYSYGYVVYYFDYWGQGALVTVSS

SEQ ID NO: 3112 - protein, 16 aa, Artificial Sequence
  Description of Artificial Sequence: Synthetic peptide
AKAQYSYGYVVYYFDY

SEQ ID NO: 3113 - protein, 110 aa, Artificial Sequence
  Description of Artificial Sequence: Synthetic polypeptide
NFMLTQPHSVSESPGKTVTISCTRSSGSIASNYVQWYQQRPGSSPTIVIYEDNQRPSGVPDRFSGSIDSSSNSASLTISGLKTEDEADYYCQSYDSSNVVFGGGTKLTVL

SEQ ID NO: 3114 - protein, 9 aa, Artificial Sequence
  Description of Artificial Sequence: Synthetic peptide
QSYDSSNVV

SEQ ID NO: 3115 - protein, 125 aa, Artificial Sequence
  Description of Artificial Sequence: Synthetic polypeptide
EVQLVESGGGLIQPGRSLRLSCAASGFTFDDYAMHWVRQAPGKGLEWVSGTSWNSGTIGYADSVKGRFTISRDNAKNSLYLQMNRLRAEDTALYHCAKDIGSKRSTSENYGMDVWGQGTTVTVSS

SEQ ID NO: 3116 - protein, 18 aa, Artificial Sequence
  Description of Artificial Sequence: Synthetic peptide
AKDIGSKRSTSENYGMDV

SEQ ID NO: 3117 - protein, 108 aa, Artificial Sequence
  Description of Artificial Sequence: Synthetic polypeptide
SYVLTQPPSVSVAPGKTARITCGGNNIGSKSVHWYQQKPGQAPVLVVYDDSDRPSGIPERFSGSNSGNTATLTISKVEAGDEADYYCQVWDSSSDSVVFGGGTKLTVL

SEQ ID NO: 3118 - protein, 11 aa, Artificial Sequence
  Description of Artificial Sequence: Synthetic peptide
QVWDSSSDSVV

SEQ ID NO: 3119 - protein, 125 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGIIGYADSVMGRFTISRDNAKNSLYLQMNSLRAEDTALYYCAKDGGSGTTEYEAYYFDYWGQGTLVTVSS

SEQ ID NO: 3120 - protein, 18 aa, Artificial Sequence
  Description of Artificial Sequence: Synthetic peptide
AKDGGSGTTEYEAYYFDY

SEQ ID NO: 3121 - protein, 110 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVL

SEQ ID NO: 3122 - protein, 11 aa, Artificial Sequence
  Description of Artificial Sequence: Synthetic peptide
AAWDDSLNGVV

SEQ ID NO: 3123 - protein, 120 aa, Artificial Sequence
  Description of Artificial Sequence: Synthetic polypeptide
EVQLVQSGAEVKKPGESLKISCKGSGYSFTSHWIGWVRQMPGKGLEWMGIIYPGDSDTRYSPSFQGQVTISADKSISTAYLQWSSLKASDTAMYYCARLPSGRYNWFDPWGQGTLVTVSS

SEQ ID NO: 3124 - protein, 13 aa, Artificial Sequence
  Description of Artificial Sequence: Synthetic peptide
ARLPSGRYNWFDP

SEQ ID NO: 3125 - protein, 111 aa, Artificial Sequence
  Description of Artificial Sequence: Synthetic polypeptide
  MOD_RES (3)..(4): Any amino acid
QSXXTQPPSASGTPGQRVTISCSGSSSNIGSNTVNWYQQLPGTAPKLLIYSNNQRPSGVPDRFSGSKSGTSASLAISGLQSEDEADYYCAAWDDSLNGHVVFGGGTKLTVL

SEQ ID NO: 3126 - protein, 12 aa, Artificial Sequence
  Description of Artificial Sequence: Synthetic peptide
AAWDDSLNGHVV

SEQ ID NO: 3127 - protein, 119 aa, Artificial Sequence
  Description of Artificial Sequence: Synthetic polypeptide
QVQLVQSGAEVKKPGASVKVSCKASGYTFTSYDVNWVRQATGQGLEWMGWMNPNSGSAGYAQKFQGRVTMTRNTSISTAYMELSSLRSEDTAVYYCARGFSLTWYFDLWGRGTLVTVSS

SEQ ID NO: 3128 - protein, 12 aa, Artificial Sequence
  Description of Artificial Sequence: Synthetic peptide
ARGFSLTWYFDL

SEQ ID NO: 3129 - protein, 110 aa, Artificial Sequence
  Description of Artificial Sequence: Synthetic polypeptide
  MOD_RES (3)..(3): Any amino acid
SYXLTQPPSVSVAPGKTARITCGGNNIGSKSVHWYQQKPGQAPVLVVYDDSDRPSGIPERFSGSNSGNTATLTISRVEAGDEADYYCQVWDSTSDHPDVVFGGGTKLTVL

SEQ ID NO: 3130 - protein, 13 aa, Artificial Sequence
  Description of Artificial Sequence: Synthetic peptide
QVWDSTSDHPDVV

SEQ ID NO: 3131 - protein, 138 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTTYSPSFQGQVTISADKSVTTAYLQWSSLKASDTAMYYCARLPQEEKRFLEWLPPANVRKQIPYYYGMDVWGQGTTVTVSS

SEQ ID NO: 3132 - protein, 31 aa, Artificial Sequence
  Description of Artificial Sequence: Synthetic polypeptide
ARLPQEEKRFLEWLPPANVRKQIPYYYGMDV

SEQ ID NO: 3133 - protein, 113 aa, Artificial Sequence
  Description of Artificial Sequence: Synthetic polypeptide
  MOD_RES (3)..(3): Any amino acid
QSXLTQPPSVSGAPGQRVTISCTGSSSNIGADYDVHWYQQLPGTAPKLLIYGNSNRPSGVPDRFSGSKSGTSASLAITGLQAEDEADYYCQSYDSSLSGPYWVFGGGTKLTVL

SEQ ID NO: 3134 - protein, 13 aa, Artificial Sequence
  Description of Artificial Sequence: Synthetic peptide
QSYDSSLSGPYWV

SEQ ID NO: 3135 - protein, 130 aa, Artificial Sequence; identical to SEQ ID NO: 163
  Description of Artificial Sequence: Synthetic polypeptide

SEQ ID NO: 3136 - protein, 23 aa, Artificial Sequence
  Description of Artificial Sequence: Synthetic peptide
AKIADIVRAYDFWSGQHFDAFDI

SEQ ID NO: 3137 - protein, 108 aa, Artificial Sequence
  Description of Artificial Sequence: Synthetic polypeptide
QSALTQPPSASGTPGQRVTISCSGSSSNIGSNTVNWYQQLPGTAPKLLIYSNNQRPSGVPDRFSGSKSGTSASLAISGLQSEDEADYYCAAWDDSLVVFGGGTKLTVL

SEQ ID NO: 3138 - protein, 9 aa, Artificial Sequence
  Description of Artificial Sequence: Synthetic peptide
AAWDDSLVV

SEQ ID NO: 3139 - protein, 124 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGTIGYADSVQGRFIISRDNAKNSLYLQMNSLRAEDTALYYCAKDMGRDDSSGSLLFDYWGQGTLVTVSS

SEQ ID NO: 3140 - protein, 17 aa, Artificial Sequence
  Description of Artificial Sequence: Synthetic peptide
AKDMGRDDSSGSLLFDY

SEQ ID NO: 3141 - protein, 108 aa, Artificial Sequence
  Description of Artificial Sequence: Synthetic polypeptide
SYVLTQPPSVSVAPGKTARITCGGNNIGSKSVHWFQQKPGQAPVLVVYDDSDRPSGIPERFSGSNSGNTATLTISRVEAGDEADYYCQVWDSSSDHVVFGGGTKLTVL

SEQ ID NO: 3142 - protein, 11 aa, Artificial Sequence
  Description of Artificial Sequence: Synthetic peptide
QVWDSSSDHVV

SEQ ID NO: 3143 - protein, 120 aa, Artificial Sequence
  Description of Artificial Sequence: Synthetic polypeptide
QVQLQESGPGLVKPSQTLSLTCTVSGGSISSGSYYWSWIRQPAGKGLEWIGHIYTSGSTNYNPSLKSRVTISVDTSKNQFSLKLSSVTAADTAVYYCAREIPSTWYFDLWGRGTLVTVSS

SEQ ID NO: 3144 - protein, 12 aa, Artificial Sequence
  Description of Artificial Sequence: Synthetic peptide
AREIPSTWYFDL

SEQ ID NO: 3145 - protein, 111 aa, Artificial Sequence; identical to SEQ ID NO: 697
  Description of Artificial Sequence: Synthetic polypeptide

SEQ ID NO: 3146 - protein, 12 aa, Artificial Sequence
  Description of Artificial Sequence: Synthetic peptide
AAWDDSLSGYWV

SEQ ID NO: 3147 - protein, 121 aa, Artificial Sequence
  Description of Artificial Sequence: Synthetic polypeptide
EVQLVESGGGLVQPGGSLRLSCAASGFTFSSYWMSWVRQAPGKGLEWVATIKQDGSEKYYVDSVKGRFTISRDNAKNSLYLQMNSLRAEDTAVYYCARGDYDFWSGYYDYWGQGTLVTVSS

SEQ ID NO: 3148 - protein, 14 aa, Artificial Sequence
  Description of Artificial Sequence: Synthetic peptide
ARGDYDFWSGYYDY

SEQ ID NO: 3149 - protein, 106 aa, Artificial Sequence
  Description of Artificial Sequence: Synthetic polypeptide
  MOD_RES (3)..(3): Any amino acid
SYXLTQPPSVSVSPGQTARITCSGDAFPNQYAYWYQQKPGQAPVLVIYKDSERPSGIPERFSGSSSGTTVTLTISGVQAEDEADYYCQSADSSSWVFGGGTKLTVL

SEQ ID NO: 3150 - protein, 9 aa, Artificial Sequence
  Description of Artificial Sequence: Synthetic peptide
QSADSSSWV

SEQ ID NO: 3151 - protein, 120 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTRYAQKFQGRVTMTRDTSTSTVYMELSSLRSEDTAVYYCAREGVGGTSYFDYWGQGTLVTVSS

SEQ ID NO: 3152 - protein, 13 aa, Artificial Sequence
  Description of Artificial Sequence: Synthetic peptide
AREGVGGTSYFDY

SEQ ID NO: 3153 - protein, 108 aa, Artificial Sequence
  Description of Artificial Sequence: Synthetic polypeptide
SYVLTQPPSVSVAPGKTARITCGGNNIGSKSVHWYQQKPGQAPVLVVYDDSDRPSGIPERFSGSNSGNTATLTISRVEAGDEADYYCQVWDSSSDPYVFGTGTKVTVL

SEQ ID NO: 3154 - protein, 11 aa, Artificial Sequence
  Description of Artificial Sequence: Synthetic peptide
QVWDSSSDPYV

SEQ ID NO: 3155 - protein, 123 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGLSGHFPHNWFDPWGQGTLVTVSS

SEQ ID NO: 3156 - protein, 16 aa, Artificial Sequence
  Description of Artificial Sequence: Synthetic peptide
ARDGLSGHFPHNWFDP

SEQ ID NO: 3157 - protein, 110 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLRGVFGGGTKLTVL

SEQ ID NO: 3158 - protein, 10 aa, Artificial Sequence
  Description of Artificial Sequence: Synthetic peptide
QSYDSSLRGV

SEQ ID NO: 3159 - protein, 120 aa, Artificial Sequence; identical to SEQ ID NO: 147
  Description of Artificial Sequence: Synthetic polypeptide

SEQ ID NO: 3160 - protein, 13 aa, Artificial Sequence
  Description of Artificial Sequence: Synthetic peptide
ARAGTTNSDYFDY

SEQ ID NO: 3161 - protein, 108 aa, Artificial Sequence
  Description of Artificial Sequence: Synthetic polypeptide
SYVLTQPPSVSVAPGKTARITCGGNNIGSKSVHWYQQKPGQAPVLVIYYDTDRPSGIPERFSGSNSGNTATLTISRVEAGDEADYYCQVWDSSSALWVFGGGTKLTVL

SEQ ID NO: 3162 - protein, 11 aa, Artificial Sequence
  Description of Artificial Sequence: Synthetic peptide
QVWDSSSALWV

SEQ ID NO: 3163 - protein, 121 aa, Artificial Sequence; identical to SEQ ID NO: 3087
  Description of Artificial Sequence: Synthetic polypeptide

SEQ ID NO: 3164 - protein, 14 aa, Artificial Sequence
  Description of Artificial Sequence: Synthetic peptide
AKGSSSGWTRPLDY

SEQ ID NO: 3165 - protein, 108 aa, Artificial Sequence
  Description of Artificial Sequence: Synthetic polypeptide
SYVLTQPPSVSVAPGKTARITCGGNNIGSKSVHWYQQKPGQAPVLVVYDDSDRPSGIPERFSGSNSGNTATLTISRVEAGDEADYYCQVWDSSSDPVVFGGGTKLTVL

SEQ ID NO: 3166 - protein, 11 aa, Artificial Sequence
  Description of Artificial Sequence: Synthetic peptide
QVWDSSSDPVV

SEQ ID NO: 3167 - protein, 125 aa, Artificial Sequence
  Description of Artificial Sequence: Synthetic polypeptide
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDLGYCSSTNCYYYYWGQGTLVTVSS

SEQ ID NO: 3168 - protein, 16 aa, Artificial Sequence
  Description of Artificial Sequence: Synthetic peptide
TTDLGYCSSTNCYYYY

SEQ ID NO: 3169 - protein, 108 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPVFGGGTKLTVL

SEQ ID NO: 3170 - protein, 11 aa, Artificial Sequence
  Description of Artificial Sequence: Synthetic peptide
QVWDSSSDHPV

SEQ ID NO: 3171 - protein, 126 aa, Artificial Sequence
  Description of Artificial Sequence: Synthetic polypeptide
QVQLVQSGAEVKKPGASVKVSCKASGYTFTDYYMHWVRQAPGQGLEWMGWINPNSGGTNYAQKFQGRVTMTRDTSISTAYMELSRLRSDDTAVYYCASGIGHNWNYVSTPNGMDVWGQGTTVTVSS

SEQ ID NO: 3172 - protein, 19 aa, Artificial Sequence
  Description of Artificial Sequence: Synthetic peptide
ASGIGHNWNYVSTPNGMDV

SEQ ID NO: 3173 - protein, 109 aa, Artificial Sequence
  Description of Artificial Sequence: Synthetic polypeptide
NFMLTQPHSVSESPGKTVTISCTRSSGSIASNYVQWYQQRPGSAPTTVIYEDYQRPSGVPDRFSGSIDSSSNSASLTISGLKTEDEADYYCQSYDSGVVFGGGTKLTVL

SEQ ID NO: 3174 - protein, 8 aa, Artificial Sequence
  Description of Artificial Sequence: Synthetic peptide
QSYDSGVV

SEQ ID NO: 3175 - protein, 127 aa, Artificial Sequence
  Description of Artificial Sequence: Synthetic polypeptide
QVQLVQSGAEVKKPGASVKVSCKASGYTFTGYSMHWVRQAPGQGLEWMGWINPNSGGTNYAQKFQGRVTMTRDTSISTAYMELSRLGSDDTAVYYCARDLEYCSSTSCYTSTTFDYWGQGTLVTVSS

SEQ ID NO: 3176 - protein, 20 aa, Artificial Sequence
  Description of Artificial Sequence: Synthetic peptide
ARDLEYCSSTSCYTSTTFDY

SEQ ID NO: 3177 - protein, 105 aa, Artificial Sequence
  Description of Artificial Sequence: Synthetic polypeptide
SYVLTQPPSVSVAPGKTARITCGGNNIGSKSVHWYQQKPGQAPVLVVYDDSDRPSGIPERFSGSNSGNTATLTISRVEAGDEADYYCQVWDYGVVFAGGTKLTVL

SEQ ID NO: 3178 - protein, 8 aa, Artificial Sequence
  Description of Artificial Sequence: Synthetic peptide
QVWDYGVV

SEQ ID NO: 3179 - protein, 120 aa, Artificial Sequence
  Description of Artificial Sequence: Synthetic polypeptide
QVQLVQSGAEVKKPGASVKVSCKASGYTVTGYYIHWVRQAPGQGLEWMGWISPNSGGTNYAQKFQGWVTMTRDMSITTAYMELSRLRSDDTAVYYCAREPYFDLGGMDVWGQGTTVTVSS

SEQ ID NO: 3180 - protein, 13 aa, Artificial Sequence
  Description of Artificial Sequence: Synthetic peptide
AREPYFDLGGMDV

SEQ ID NO: 3181 - protein, 110 aa, Artificial Sequence
  Description of Artificial Sequence: Synthetic polypeptide
  MOD_RES (3)..(3): Any amino acid
QSXLTQPASVSGSPGQSITISCTGTSSDVGSYNLVSWYQQHPGKAPKLMIYEGSKRPSGVSNRFSGSKSGNTASLTISGLQAEDEADYYCCSYAGSSTRVFGGGTKLTVL

SEQ ID NO: 3182 - protein, 10 aa, Artificial Sequence
  Description of Artificial Sequence: Synthetic peptide
CSYAGSSTRV

SEQ ID NO: 3183 - protein, 129 aa, Artificial Sequence
  Description of Artificial Sequence: Synthetic polypeptide
QVQLVQSGAELKKPGASVKVSCKASGYTFNSYGISWVRQAPGQGLEWMGGISAYNGNTNYAQKLQGRVTMTTDTSTSTAYMELRSLRSDDTAVYYCARRVEDNGDDGGDYYYYYGMDVWGQGTTVTVSS

SEQ ID NO: 3184 - protein, 22 aa, Artificial Sequence
  Description of Artificial Sequence: Synthetic peptide
ARRVEDNGDDGGDYYYYYGMDV

SEQ ID NO: 3185 - protein, 108 aa, Artificial Sequence
  Description of Artificial Sequence: Synthetic polypeptide
SYVLTQPPSVSVSPGQTARITCSGEALPKQYAYWYQQKPGQAPVMVIYKDSERPSGIPERFSGSSSGTTVTLTISGVQAEDDADYYCQSADSSGTLVVFGGGTKLTVL

SEQ ID NO: 3186 - protein, 11 aa, Artificial Sequence
  Description of Artificial Sequence: Synthetic peptide
QSADSSGTLVV

SEQ ID NO: 3187 - protein, 123 aa, Artificial Sequence; identical to SEQ ID NO: 151
  Description of Artificial Sequence: Synthetic polypeptide

SEQ ID NO: 3188 - protein, 14 aa, Artificial Sequence
  Description of Artificial Sequence: Synthetic peptide
TTDDPGSYYYGMDV

SEQ ID NO: 3189 - protein, 109 aa, Artificial Sequence
  Description of Artificial Sequence: Synthetic polypeptide
QSVLTQEPSLTVSPGGTVTLTCGSSTGAVTSGHYPYWFQQKPGQAPRTLIYDTSNKHSWTPARFSGSLLGGKGALTLSGAQPEDEAEYYCLLSYSGARVFGGGTKLTVL

SEQ ID NO: 3190 - protein, 9 aa, Artificial Sequence
  Description of Artificial Sequence: Synthetic peptide
LLSYSGARV

SEQ ID NO: 3191 - protein, 125 aa, Artificial Sequence
  Description of Artificial Sequence: Synthetic polypeptide
QVQLVQSGAEVKKPGSSVKVSCKASGGTFSSYAISWGRQAPGQGLEWMGGIIPILGTVNYAQKFQGRVTITADKSTSTAYMELSSLRSEDTAVYYCARVLGYYDSSGSNDAFDIWGQGTMVTVSS

SEQ ID NO: 3192 - protein, 18 aa, Artificial Sequence
  Description of Artificial Sequence: Synthetic peptide
ARVLGYYDSSGSNDAFDI

SEQ ID NO: 3193 - protein, 111 aa, Artificial Sequence
  Description of Artificial Sequence: Synthetic polypeptide
  MOD_RES (3)..(4): Any amino acid
QSXXTQPPSVSGAPGQRVTISCTGSSSNIGAGYDVHWYQQLPGTAPKLLIYANINRPSGVPDRFSGSKSGTSASLAITGLQAEDEADYYCQSYDSSLSGSVFGGGTKLTVL

SEQ ID NO: 3194 - protein, 11 aa, Artificial Sequence
  Description of Artificial Sequence: Synthetic peptide
QSYDSSLSGSV

SEQ ID NO: 3195 - protein, 130 aa, Artificial Sequence; identical to SEQ ID NO: 113
  Description of Artificial Sequence: Synthetic polypeptide

SEQ ID NO: 3196 - protein, 21 aa, Artificial Sequence
  Description of Artificial Sequence: Synthetic peptide
TTDCFWRLGGTTCYEHDAFDV

SEQ ID NO: 3197 - protein, 106 aa, Artificial Sequence
  Description of Artificial Sequence: Synthetic polypeptide
DIQMTQSPSSLSASVGDRVTITCRASQAIATFLNWYQQKPGKAPKLLIYAASSLQSGVPSRFSGSGSGTDFTLTISNLQPEDFATYYCQQSYNSLHFGGGTQVEMK

SEQ ID NO: 3198 - protein, 8 aa, Artificial Sequence
  Description of Artificial Sequence: Synthetic peptide
QQSYNSLH

SEQ ID NO: 3199 - protein, 128 aa, Artificial Sequence
  Description of Artificial Sequence: Synthetic polypeptide
EVQLVESGGGLAQPGGSLRLSCAASGFTFSTYDMHWVRQTTGKGLEWVSAIGTAGDTYYPDSVKGRFTISREDAKNSLYLQMNSLRAGDTAVYYCARGHHSPICSSSRCSYYYYFDVWGQGTAVTVSS

SEQ ID NO: 3200 - protein, 22 aa, Artificial Sequence
  Description of Artificial Sequence: Synthetic peptide
ARGHHSPICSSSRCSYYYYFDV

SEQ ID NO: 3201 - protein, 108 aa, Artificial Sequence
  Description of Artificial Sequence: Synthetic polypeptide
DIQMTQSPSSLSASVGDRVTITCRASQSITSYLNWYQQKPGKAPKLLIYAASSLQSGVPSRFSGSGSGTDFTLTISSLQPEDFATYYCQQSYTTHMYTFGQGTKLEIK

SEQ ID NO: 3202 - protein, 10 aa, Artificial Sequence
  Description of Artificial Sequence: Synthetic peptide
QQSYTTHMYT

SEQ ID NO: 3203 - protein, 120 aa, Artificial Sequence
  Description of Artificial Sequence: Synthetic polypeptide
EVQLVESGGGLVQPGGSLRLSCAASGFTFSRYDMHWVRQGTGKGLEWVSAIGTSGDTYYPDSVKGRFTISRENAKNSLYLQMNSLRAGDTAVYYCARGGLQTTTWLFDYWGQGTLVTVSS

SEQ ID NO: 3204 - protein, 14 aa, Artificial Sequence
  Description of Artificial Sequence: Synthetic peptide
ARGGLQTTTWLFDY

SEQ ID NO: 3205 - protein, 108 aa, Artificial Sequence
  Description of Artificial Sequence: Synthetic polypeptide
DIQMTQSPSSLSASVGDRVTITCRASQSISRYLNWYQQKPGKAPKLLIYAASSLQSGVPSRFSGSGAGTDFTLTISSLQPEDFAIYYCQQSYSNPPITFGQGTRLEIK

SEQ ID NO: 3206 - protein, 10 aa, Artificial Sequence
  Description of Artificial Sequence: Synthetic peptide
QQSYSNPPIT

SEQ ID NO: 3207 - protein, 126 aa, Artificial Sequence
  Description of Artificial Sequence: Synthetic polypeptide
EVQLLESGGSLVQPGGSLRLSCAASGFTFSSYAMSWVRQAPGKGLEWVSTISGGGDSTYYADSVKGRFTISRDNSKNTLYLQMNSLRAGDTAVYYCAKTSSTYYDTLTGEVNFDYWGQGTLVTVSS

SEQ ID NO: 3208 - protein, 19 aa, Artificial Sequence
  Description of Artificial Sequence: Synthetic peptide
AKTSSTYYDTLTGEVNFDY

SEQ ID NO: 3209 - protein, 107 aa, Artificial Sequence
  Description of Artificial Sequence: Synthetic polypeptide
EIVLTQSPATLSLSPGERATLSCRASQSISNYLAWYQQRPGQAPRLLIYDASTRATGIPARFSGSGSGTDFTLTISSLEPEDFAVYYCQQRYNWPLTFGGGTKVEIK

SEQ ID NO: 3210 - protein, 9 aa, Artificial Sequence
  Description of Artificial Sequence: Synthetic peptide
QQRYNWPLT

SEQ ID NO: 3211 - protein, 132 aa, Artificial Sequence
  Description of Artificial Sequence: Synthetic polypeptide
EVQLVESGGGLVKPGGSLRLSCAASGFTFSSYNMNWVRQAPGKGLEWVSLISSTSSHIYYADSVKGRFTISRDNAKNSLYLQMDSLRAEDTAVYYCAREGAPPYCSGGSCYSLYYDDACDIWGQGTRVTVSS

SEQ ID NO: 3212 - protein, 25 aa, Artificial Sequence
  Description of Artificial Sequence: Synthetic peptide
AREGAPPYCSGGSCYSLYYDDACDI

SEQ ID NO: 3213 - protein, 108 aa, Artificial Sequence
  Description of Artificial Sequence: Synthetic polypeptide
EIVLTQSPGTLSLSPGERATLSCRTSQTVSSSYLAWYQQKPGQAPRLLIYGASSRATGIPDRFSGSGSGTDFTLTISRLEPEDFAVYYCQQYGGSPRTFGQGTKVEIK

SEQ ID NO: 3214 - protein, 9 aa, Artificial Sequence
  Description of Artificial Sequence: Synthetic peptide
QQYGGSPRT

SEQ ID NO: 3215 - protein, 125 aa, Artificial Sequence
  Description of Artificial Sequence: Synthetic polypeptide
EVQLVQSGAEVKKPGESLKISCKGSGYRFTSYWIGWVRQMPGKGLEWMGIIYPGDSDTRYSPSFQGQVTISADKSISTAYLQWSSLKASDTAMYYCARCSSSSGRSFHQYSMDVWGQGTTVTVSP

SEQ ID NO: 3216 - protein, 18 aa, Artificial Sequence
  Description of Artificial Sequence: Synthetic peptide
ARCSSSSGRSFHQYSMDV

SEQ ID NO: 3217 - protein, 107 aa, Artificial Sequence
  Description of Artificial Sequence: Synthetic polypeptide
DIQMTQSPSSLSASVGDRVTITCRASQSISTFLNWYQQKPGKAPKLLIYTASSLQSGVPSRFSGSGSGTDFTLTIRSLQPEDFATYYCQQTDSNPPHSFGQGTKLEI

SEQ ID NO: 3218 - protein, 10 aa, Artificial Sequence
  Description of Artificial Sequence: Synthetic peptide
QQTDSNPPHS

SEQ ID NO: 3219 - protein, 133 aa, Artificial Sequence
  Description of Artificial Sequence: Synthetic polypeptide
EVQLVESGGGLVQPGRSLRLSCAASGFTFDDYDMHWVRQAPGKGLEWVSGISWNSGNIGYADSVKGRFTISRDNAKNSLYLQMSSLRAEDTALYYCAKVCGGILPENRWGYTGYDHSPCSDYWGQGTLVTVSS

SEQ ID NO: 3220 - protein, 26 aa, Artificial Sequence
  Description of Artificial Sequence: Synthetic peptide
AKVCGGILPENRWGYTGYDHSPCSDY

SEQ ID NO: 3221 - protein, 106 aa, Artificial Sequence
  Description of Artificial Sequence: Synthetic polypeptide
EIVLTQSPATLSLSPGERATLSCRASQSVSNFLAWYQQKPGQAPRLLIYDASNRATGIPARFSGSGSGTDFTLTISSLEPEDFAVYYCQQRRNWLTFGGGTKVEIK

SEQ ID NO: 3222 - protein, 8 aa, Artificial Sequence
  Description of Artificial Sequence: Synthetic peptide
QQRRNWLT

SEQ ID NO: 3223 - protein, 131 aa, Artificial Sequence
  Description of Artificial Sequence: Synthetic polypeptide
QVQLVQSGAEVKKPGSSVKVSCKASGGTFSRHVISWVRQAPGQGLEWMGGIIPMFGTANYAQKFQGRVTITADESTSTAYMELSSLRSEDTAVYYCAREDFILVSAPIRENSYYYYGMDVWGQGTTVTVSS

SEQ ID NO: 3224 - protein, 24 aa, Artificial Sequence
  Description of Artificial Sequence: Synthetic peptide
AREDFILVSAPIRENSYYYYGMDV

SEQ ID NO: 3225 - protein, 108 aa, Artificial Sequence; identical to SEQ ID NO: 116
  Description of Artificial Sequence: Synthetic polypeptide

SEQ ID NO: 3226 - protein, 9 aa, Artificial Sequence
  Description of Artificial Sequence: Synthetic peptide
QQYGGSPRT

SEQ ID NO: 3227 - protein, 117 aa, Artificial Sequence
  Description of Artificial Sequence: Synthetic polypeptide
EVQLLESGGGLVQPGGSLRLSCAASGFTFSNYVMNWVRQAPGKGLEWVSAISGSAGATNYADSVMGRFTISRDNSKNTLYLQMNGLRAEDTAVYFCAKTGPSQGDYWGLGTLVSVSS

SEQ ID NO: 3228 - protein, 10 aa, Artificial Sequence
  Description of Artificial Sequence: Synthetic peptide
AKTGPSQGDY

SEQ ID NO: 3229 - protein, 112 aa, Artificial Sequence
  Description of Artificial Sequence: Synthetic polypeptide
DIVMTQSPDSLAVSLGERATINCKSSQSLLYSSNNKNYLAWYQQKPGQPPKRLIYWASTRESGVPDRFSGSGSGTDFTLTISSLQAEDVAVYYCQQYYSWCSFGQGTKLEIK

SEQ ID NO: 3230 - protein, 8 aa, Artificial Sequence
  Description of Artificial Sequence: Synthetic peptide
QQYYSWCS

SEQ ID NO: 3231 - protein, 115 aa, Artificial Sequence
  Description of Artificial Sequence: Synthetic polypeptide
EVQLVESGGGLVQPGGSLRVSCAASGLTVSYNYMTWVRQIPGKGLDWVSVIYPGGSTFYADAVRGRFTISRDNSKNTLYLQMNGLRVEDTAVYYCARESYGLDVWGQGTTVTVSS

SEQ ID NO: 3232 - protein, 9 aa, Artificial Sequence
  Description of Artificial Sequence: Synthetic peptide
ARESYGLDV

SEQ ID NO: 3233 - protein, 109 aa, Artificial Sequence
  Description of Artificial Sequence: Synthetic polypeptide
EIVLTQSPGTLSLSPGERATLSCRASQGISSNYLAWYQQKPGQAPRLLIYGASSRATGIPDRFSGSGSGTDFTLTISRLEPEDFAVYYCQLYGSSSGYTFGQGTKLEIK

SEQ ID NO: 3234 - protein, 10 aa, Artificial Sequence
  Description of Artificial Sequence: Synthetic peptide
QLYGSSSGYT

SEQ ID NO: 3235 - protein, 117 aa, Artificial Sequence
  Description of Artificial Sequence: Synthetic polypeptide
EVQLVESGGGLIQPGGSLRLSCAASGITVSSNYMTWVRQAPGKGLEWVSLIYAGGSTFYAESVKGRFIISRDNSNNTVYLQMNSLRADDTAVYYCARDLDYYGMDVWGQGTTVTVSS

SEQ ID NO: 3236 - protein, 11 aa, Artificial Sequence
  Description of Artificial Sequence: Synthetic peptide
ARDLDYYGMDV

SEQ ID NO: 3237 - protein, 106 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLGSSPVCFGPGTKLDI

SEQ ID NO: 3238 - protein, 9 aa, Artificial Sequence
  Description of Artificial Sequence: Synthetic peptide
QQLGSSPVC

SEQ ID NO: 3239 - protein, 122 aa, Artificial Sequence
  Description of Artificial Sequence: Synthetic polypeptide
EVQLVESGGGLVQPGGSLRLSCAASGFTFRNYDMHWVRQVAGKGLEWVSGIGTAGDTYYPDSVKGRFTISRENAKNSVYLQMNNLRAGDTAVYFCARDREISGWTGWYFDLWGRGTLVIVSS

SEQ ID NO: 3240 - protein, 16 aa, Artificial Sequence
  Description of Artificial Sequence: Synthetic peptide
ARDREISGWTGWYFDL

SEQ ID NO: 3241 - protein, 108 aa, Artificial Sequence
  Description of Artificial Sequence: Synthetic polypeptide
DIQMTQSPSSLSASVGDRVTITCRASQTIHNYLNWYHQIPGKPPRLLIYTTNNLQSGVPSRFSGSGSGTDFTLTITGLQPEDFATYYCQQSYSTPPITFGQGTRLEIK

SEQ ID NO: 3242 - protein, 10 aa, Artificial Sequence
  Description of Artificial Sequence: Synthetic peptide
QQSYSTPPIT

SEQ ID NO: 3243 - protein, 128 aa, Artificial Sequence
  Description of Artificial Sequence: Synthetic polypeptide
QVQLVESGGGVVQPGRSLRLSCAASGFTFSSSGMHWVRQAPGKGLEWVAVISYDGSNKYYEDSVKGRFTISRDNSKNTLYLQLNNLRVEDTAVYYCARDTPGGDDIMTGWGLYGMDVWGQGTTVTVSS

SEQ ID NO: 3244 - protein, 21 aa, Artificial Sequence
  Description of Artificial Sequence: Synthetic peptide
ARDTPGGDDIMTGWGLYGMDV

SEQ ID NO: 3245 - protein, 106 aa, Artificial Sequence
  Description of Artificial Sequence: Synthetic polypeptide
  MOD_RES (83)..(83): Any amino acid
DIQMTQSPSSLSASVGDRVTITCRSSQSISRYLNWYQHKPGKAPKLLIYAAISLQSGVPSRFSGDGSGTDFTLTISSLQLEDXAHSSCQHSYSTPSTFGQGHKGAI

SEQ ID NO: 3246 - protein, 9 aa, Artificial Sequence
  Description of Artificial Sequence: Synthetic peptide
QHSYSTPST

SEQ ID NO: 3247 - protein, 122 aa, Artificial Sequence
  Description of Artificial Sequence: Synthetic polypeptide
EVQLVESGGGLVQPGGSLRLSCAASGFTFRNYDMHWLLQVAGKGLEWVSAIGTSGDTYYPDSVKGRFTISRENAKNSVYLQMNNLRAGDTAVYFCVRDREISGWTGWYFDLWGRGTLVIVSS

SEQ ID NO: 3248 - protein, 16 aa, Artificial Sequence
  Description of Artificial Sequence: Synthetic peptide
VRDREISGWTGWYFDL

SEQ ID NO: 3249 - protein, 108 aa, Artificial Sequence; identical to SEQ ID NO: 104
  Description of Artificial Sequence: Synthetic polypeptide

SEQ ID NO: 3250 - protein, 10 aa, Artificial Sequence
  Description of Artificial Sequence: Synthetic peptide
QQSYSTPPIT

SEQ ID NO: 3251 - protein, 123 aa, Artificial Sequence
  Description of Artificial Sequence: Synthetic polypeptide
QVQLVQSGAEVKKPGASVKVSCKASGYTFTDYYIHWVRQAPGQGLEWMGWINPKTGGINFAQKFQGRVTMTRDSSITTVYMELSRLTSDDTAIYYCATDDGGSWSGSSWFDPWGQGTLVTVSS

SEQ ID NO: 3252 - protein, 16 aa, Artificial Sequence
  Description of Artificial Sequence: Synthetic peptide
ATDDGGSWSGSSWFDP

SEQ ID NO: 3253 - protein, 108 aa, Artificial Sequence
  Description of Artificial Sequence: Synthetic polypeptide
DIQMTQSPSSLSASVGDRVTITCRASQSISSDLNWYRQKPGKAPRLLIYAASSLQSGVPSRFSGSGSGTDFTLTISSLQPEDFATYYCQQSYSTPPFTFGPGTKVDIK

SEQ ID NO: 3254 - protein, 10 aa, Artificial Sequence
  Description of Artificial Sequence: Synthetic peptide
QQSYSTPPFT

SEQ ID NO: 3255 - protein, 127 aa, Artificial Sequence
  Description of Artificial Sequence: Synthetic polypeptide
QVQLVESGGGVVQPGRSLRLSCAASGFTFSTYGMNWVRQAPGKGLEWVALILYDGSDKYYADSVKSRFTISRDNSRNTLYLQMTSLRAEDTAVYYCAKALSSTYYYDASGPDAFDIWGQGTMVTVSA

SEQ ID NO: 3256 - protein, 20 aa, Artificial Sequence
  Description of Artificial Sequence: Synthetic peptide
AKALSSTYYYDASGPDAFDI

SEQ ID NO: 3257 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSIESGVPPRFSGSGSGTEFTLTISSLQPDDFATYYCQQYNSYSYTFGQGTKLEIK

SEQ ID NO: 3258 - protein, 9 aa, Artificial Sequence
  Description of Artificial Sequence: Synthetic peptide
QQYNSYSYT

SEQ ID NO: 3259 - protein, 122 aa, Artificial Sequence
  Description of Artificial Sequence: Synthetic polypeptide
EVQLLESGGGLVQPGGSLRLSCAASGFSFSNYAMSWVRQAPGKGLEWVSSISGSGGSPYYADSVKGRFTISRDSSKSTLYLQMNSLSAEDTAVYYCAKSPLVYAPHIFFDCWGQGTLVTVSS

SEQ ID NO: 3260 - protein, 15 aa, Artificial Sequence
  Description of Artificial Sequence: Synthetic peptide
AKSPLVYAPHIFFDC

SEQ ID NO: 3261 - protein, 106 aa, Artificial Sequence
  Description of Artificial Sequence: Synthetic polypeptide
EIVLTQSPATLSLSPGERATLSCRTSQSVSSSLAWYQQKPGQAPRLLIYDASNRATAVPARFSGSGSGTDFTLTISSLEPEDFAVYYCQQHSNWLTFGGGTKVEIK

SEQ ID NO: 3262 - protein, 8 aa, Artificial Sequence
  Description of Artificial Sequence: Synthetic peptide
QQHSNWLT

SEQ ID NO: 3263 - protein, 124 aa, Artificial Sequence
  Description of Artificial Sequence: Synthetic polypeptide
EVQLVESGGGLVQPGGSLRLSCAASGFTFSNYSMHWVRQAPGKGLEWVSYISSSSSTIYYADSVKGRFTISRDNAKNSLYLQLNSLRDEDTAVYYCARQGGQQLSYYYYGMDVWGQGTTVTVSS

SEQ ID NO: 3264 - protein, 17 aa, Artificial Sequence
  Description of Artificial Sequence: Synthetic peptide
ARQGGQQLSYYYYGMDV

SEQ ID NO: 3265 - protein, 107 aa, Artificial Sequence
  Description of Artificial Sequence: Synthetic polypeptide
DIQMTQSPSSLSASVGDRATITCRASQSIGSYLNWYQHKPGKAPKLLIYAASSLQSGVPSGFSGSGSGTDFTLTISSLQPEDFATYYCQQSYSTPGTFGQGTKVEIK

SEQ ID NO: 3266 - protein, 9 aa, Artificial Sequence
  Description of Artificial Sequence: Synthetic peptide
QQSYSTPGT

SEQ ID NO: 3267 - protein, 121 aa, Artificial Sequence; identical to SEQ ID NO: 117
  Description of Artificial Sequence: Synthetic polypeptide

SEQ ID NO: 3268 - protein, 14 aa, Artificial Sequence
  Description of Artificial Sequence: Synthetic peptide
ARGLDGSSSASPDS

SEQ ID NO: 3269 - protein, 107 aa, Artificial Sequence; identical to SEQ ID NO: 118
  Description of Artificial Sequence: Synthetic polypeptide

SEQ ID NO: 3270 - protein, 9 aa, Artificial Sequence
  Description of Artificial Sequence: Synthetic peptide
QQGNSFPLT

SEQ ID NO: 3271 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSAISGSGDGTFYADSVKGRFTISRDNSKNTMYLQMNSLRAEDTAVYYCAKDFGAFIIGDWFDPWGQGTLVTVSS

SEQ ID NO: 3272 - protein, 15 aa, Artificial Sequence
  Description of Artificial Sequence: Synthetic peptide
AKDFGAFIIGDWFDP

SEQ ID NO: 3273 - protein, 108 aa, Artificial Sequence
  Description of Artificial Sequence: Synthetic polypeptide
EIVMTQSPATLSVSPGERATLSCRASQTVRSNLAWYQQKPGQAPRLLIYGASTRATGIPARFSGSGSGTEFTLTISSLQSEDFAVYYCQQYNNWPPITFGQGTRLEIK

SEQ ID NO: 3274 - protein, 10 aa, Artificial Sequence
  Description of Artificial Sequence: Synthetic peptide
QQYNNWPPIT

SEQ ID NO: 3275 - protein, 125 aa, Artificial Sequence; identical to SEQ ID NO: 137
  Description of Artificial Sequence: Synthetic polypeptide

SEQ ID NO: 3276 - protein, 18 aa, Artificial Sequence
  Description of Artificial Sequence: Synthetic peptide
ATERIAVSDTRMYNWFDP

SEQ ID NO: 3277 - protein, 108 aa, Artificial Sequence; identical to SEQ ID NO: 138
  Description of Artificial Sequence: Synthetic polypeptide

SEQ ID NO: 3278 - protein, 10 aa, Artificial Sequence
  Description of Artificial Sequence: Synthetic peptide
QQSYSAPPWT

SEQ ID NO: 3279 - protein, 124 aa, Artificial Sequence; identical to SEQ ID NO: 121
  Description of Artificial Sequence: Synthetic polypeptide

SEQ ID NO: 3280 - protein, 16 aa, Artificial Sequence
  Description of Artificial Sequence: Synthetic peptide
ARLETSGWYTEDVFDI

SEQ ID NO: 3281 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLLPEDFATYYCQRSYSAMYTFGQGTRLEIQ

SEQ ID NO: 3282 - protein, 9 aa, Artificial Sequence
  Description of Artificial Sequence: Synthetic peptide
QRSYSAMYT

SEQ ID NO: 3283 - protein, 127 aa, Artificial Sequence
  Description of Artificial Sequence: Synthetic polypeptide
QVQLVESGGGVVQPGRSLRLSCATSGFTFSNYGMHWVRQAPGKGLEWVAVIWFDGSSEYYADSVKGRFTISRDNSKKTLYLQVNNLRGEDSAVYYCAREGWHYDSSYYREYDDLDIWGQGTMVTVSS

SEQ ID NO: 3284 - protein, 20 aa, Artificial Sequence
  Description of Artificial Sequence: Synthetic peptide
AREGWHYDSSYYREYDDLDI

SEQ ID NO: 3285 - protein, 113 aa, Artificial Sequence
  Description of Artificial Sequence: Synthetic polypeptide
DIVMTQTPLSLPVSLGDQASISCRSSQSLVHSDGNTYLHWYLQKPGQSPKLLIYKVSNRFSGVPDRFSGSGSGTDFTLTISRVEAEDLGVYFCSQSTHVPPWTFGGGTRLEIK

SEQ ID NO: 3286 - protein, 10 aa, Artificial Sequence
  Description of Artificial Sequence: Synthetic peptide
SQSTHVPPWT

SEQ ID NO: 3287 - protein, 117 aa, Artificial Sequence; identical to SEQ ID NO: 129
  Description of Artificial Sequence: Synthetic polypeptide

SEQ ID NO: 3288 - protein, 11 aa, Artificial Sequence
  Description of Artificial Sequence: Synthetic peptide
ARETLGRGGDC

SEQ ID NO: 3289 - protein, 107 aa, Artificial Sequence; identical to SEQ ID NO: 130
  Description of Artificial Sequence: Synthetic polypeptide

SEQ ID NO: 3290 - protein, 9 aa, Artificial Sequence
  Description of Artificial Sequence: Synthetic peptide
QQYDNLPRS

SEQ ID NO: 3291 - protein, 122 aa, Artificial Sequence
  Description of Artificial Sequence: Synthetic polypeptide
EVQLVESGGGLVQPGGSLRLSCAASGFTFSTYDMHWVRQTTEKSLEWVSAIGTAGDTYYPDSVKGRFIVSRENAKNSLYLQMNNLRAGDTAVYYCARDRETSGWYGWYFDLWGRGTLVTVSS

SEQ ID NO: 3292 - protein, 16 aa, Artificial Sequence
  Description of Artificial Sequence: Synthetic peptide
ARDRETSGWYGWYFDL

SEQ ID NO: 3293 - protein, 108 aa, Artificial Sequence
  Description of Artificial Sequence: Synthetic polypeptide
DIQMTQSPSSLSASVGDRVTVTCRASQSIRNFLNWYQQKPGKAPKLLIYTTSTLQSGVPSRFSGSGSGTDFTLTISSLQPEDFATYYCQQSYSTPPITFGQGTRLDMK

SEQ ID NO: 3294 - protein, 10 aa, Artificial Sequence
  Description of Artificial Sequence: Synthetic peptide
QQSYSTPPIT

SEQ ID NO: 3295 - protein, 128 aa, Artificial Sequence
  Description of Artificial Sequence: Synthetic polypeptide
QVQLVESGGGVVQPGRSLRLSCTASGFTFSTAGMHWVRQAPGKGLEWVAVISYDGSNKDYADSVKGRFTISRDNSKSTLYLQMNSLRPEDTAVYYCAKDTPGGDDIMTGWGLYGMDVWGQGTTVIASS

SEQ ID NO: 3296 - protein, 21 aa, Artificial Sequence
  Description of Artificial Sequence: Synthetic peptide
AKDTPGGDDIMTGWGLYGMDV

SEQ ID NO: 3297 - protein, 107 aa, Artificial Sequence
  Description of Artificial Sequence: Synthetic polypeptide
DIQMTQSPSSLSASVGDRVTITCRASQSISSYLNWYHQKPGKAPKLLIYAAISLQSGVPSRFSGSGFGTDFTLTISSLQPEDFAIYYCQQSYSTPWTFDQGTKVEIK

SEQ ID NO: 3298 - protein, 9 aa, Artificial Sequence
  Description of Artificial Sequence: Synthetic peptide
QQSYSTPWT

SEQ ID NO: 3299 - protein, 122 aa, Artificial Sequence
  Description of Artificial Sequence: Synthetic polypeptide
QVQLVQSGAEVKKPGASVKVSCKASGYTFSDYYIHWVRQAPGQGLEWMGIINPSGGSTAYAQKFQGRVTMTGDASTSTVYMELNSLRSEDTAVYYCARDIVLVPAAYGMDVWGQGTTVIVSS

SEQ ID NO: 3300 - protein, 15 aa, Artificial Sequence
  Description of Artificial Sequence: Synthetic peptide
ARDIVLVPAAYGMDV

SEQ ID NO: 3301 - protein, 108 aa, Artificial Sequence
  Description of Artificial Sequence: Synthetic polypeptide
EIVLTQSPATLSLSPGERATLSCRASQSISTYLAWYQQKPGQAPRLLIYDASNRATGIPARFSGSGSGTDFTLTISSLEPEDFAVYYCQQRNNWPPLTFGGGTKVEVK

SEQ ID NO: 3302 - protein, 10 aa, Artificial Sequence
  Description of Artificial Sequence: Synthetic peptide
QQRNNWPPLT

SEQ ID NO: 3303 - protein, 130 aa, Artificial Sequence
  Description of Artificial Sequence: Synthetic polypeptide
EVQLVESGGGLVQPGGSLRLSCAASGFTFSAYDMHWVRQVTGKGLEWVSAIGTAGDTYYPDDTFDPDSVKGRFTVSRENAKNSLYLQMNSLRAGDTAVYYCVRGDMLTGSSQYYYIMDVWGQGTTVTVSS

SEQ ID NO: 3304 - protein, 18 aa, Artificial Sequence
  Description of Artificial Sequence: Synthetic peptide
VRGDMLTGSSQYYYIMDV

SEQ ID NO: 3305 - protein, 107 aa, Artificial Sequence
  Description of Artificial Sequence: Synthetic polypeptide
DIQMTQSPSSLSASVGDRVTITCRASQSISRYLNWYQQKPGKAPKLLIYAASSLQSGVPSRFSGSGSGTDFTLTISSLQPEDFATYSCQQSYSSMYTFGQGTKLEIK

SEQ ID NO: 3306 - protein, 9 aa, Artificial Sequence
  Description of Artificial Sequence: Synthetic peptide
QQSYSSMYT

SEQ ID NO: 3307 - protein, 120 aa, Artificial Sequence; identical to SEQ ID NO: 101
  Description of Artificial Sequence: Synthetic polypeptide

SEQ ID NO: 3308 - protein, 13 aa, Artificial Sequence
  Description of Artificial Sequence: Synthetic peptide
ARDGIPFRYGMDV

SEQ ID NO: 3309 - protein, 107 aa, Artificial Sequence; identical to SEQ ID NO: 102
  Description of Artificial Sequence: Synthetic polypeptide

SEQ ID NO: 3310 - protein, 9 aa, Artificial Sequence
  Description of Artificial Sequence: Synthetic peptide
QHYHSYSGT

SEQ ID NO: 3311 - protein, 124 aa, Artificial Sequence
  Description of Artificial Sequence: Synthetic polypeptide
EVQLVESGGGLVQPGGSLRLSCVASGFSFSDYSMNWVRQAPGKGLEWVSYISSSSSTIYYADSVKGRFTMSRDNAKNSLFLQMNSLRDEDTAVYYCARHWGPQKSYYYYGMDVWGPGTTVTVSS

SEQ ID NO: 3312 - protein, 17 aa, Artificial Sequence
  Description of Artificial Sequence: Synthetic peptide
ARHWGPQKSYYYYGMDV

SEQ ID NO: 3313 - protein, 106 aa, Artificial Sequence
  Description of Artificial Sequence: Synthetic polypeptide
DIQMTQSPSSLSASVGDRVTVTCRASQSINSYLNWYQQKPGKAPKLLIYGASNLQSGVPSRFSGSESGTEFTLTISSLQPEDFATYYCQQSYSTPPAFGQGTKVEI

SEQ ID NO: 3314 - protein, 9 aa, Artificial Sequence
  Description of Artificial Sequence: Synthetic peptide
QQSYSTPPA

SEQ ID NO: 3315 - protein, 134 aa, Artificial Sequence
  Description of Artificial Sequence: Synthetic polypeptide
QVQLVQSGAEVKKPGASVKLSCKASGYSFTSYYILWVRQAPGQGLEWMGIINPSGGATSFAQKFQGRVTLTRDTSTSTVYMELSSLRSEDTALYYCARDTGDSSGWYPPPILKYNYYYYGMDVWGQGTTVTVSS

SEQ ID NO: 3316 - protein, 27 aa, Artificial Sequence
  Description of Artificial Sequence: Synthetic peptide
ARDTGDSSGWYPPPILKYNYYYYGMDV

SEQ ID NO: 3317 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPRTFGQGTKVEIK

SEQ ID NO: 3318 - protein, 9 aa, Artificial Sequence
  Description of Artificial Sequence: Synthetic peptide
LQHNSYPRT

SEQ ID NO: 3319 - protein, 130 aa, Artificial Sequence; identical to SEQ ID NO: 109
  Description of Artificial Sequence: Synthetic polypeptide

SEQ ID NO: 3320 - protein, 23 aa, Artificial Sequence
  Description of Artificial Sequence: Synthetic peptide
VKGYRYYYDILTGYYNDAGAFDY

SEQ ID NO: 3321 - protein, 107 aa, Artificial Sequence
  Description of Artificial Sequence: Synthetic polypeptide
DIQLTQSPSFLSASVGDRVTITCRASQGISSYLAWYQQKPGKAPKLLIYPASTLQSGVPSGFSGSGSGTEFTLTISSLQPEDFATYYCQQLNDYPFTFGPGTKVDIK

SEQ ID NO: 3322 - protein, 9 aa, Artificial Sequence
  Description of Artificial Sequence: Synthetic peptide
QQLNDYPFT

SEQ ID NO: 3323 - protein, 124 aa, Artificial Sequence
  Description of Artificial Sequence: Synthetic polypeptide
QLQLQESGPGLVKPSETLSLTCTVSGGSISSRNYHWGWIRQTPGKGLEWIGSIYYSGSTYYNPSLKSRVTISVDTSKNQFSLKMRSVTAADTALYFCARLETSGWYTGDVFDIWGQGTMVTVSS

SEQ ID NO: 3324 - protein, 16 aa, Artificial Sequence
  Description of Artificial Sequence: Synthetic peptide
ARLETSGWYTGDVFDI

SEQ ID NO: 3325 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAAVSLQSGVPSRFSGSGSGTDFTLTINSLQPEDFATYYCQRSYSAMYSFGQGTRLEIQ

SEQ ID NO: 3326 - protein, 9 aa, Artificial Sequence
  Description of Artificial Sequence: Synthetic peptide
QRSYSAMYS

SEQ ID NO: 3327 - protein, 121 aa, Artificial Sequence; identical to SEQ ID NO: 97
  Description of Artificial Sequence: Synthetic polypeptide

SEQ ID NO: 3328 - protein, 14 aa, Artificial Sequence
  Description of Artificial Sequence: Synthetic peptide
AKGLDSSSSASPDY

SEQ ID NO: 3329 - protein, 107 aa, Artificial Sequence; identical to SEQ ID NO: 98
  Description of Artificial Sequence: Synthetic polypeptide

SEQ ID NO: 3330 - protein, 9 aa, Artificial Sequence
  Description of Artificial Sequence: Synthetic peptide
QQGNSFPLT

SEQ ID NO: 3331 - protein, 121 aa, Artificial Sequence
  Description of Artificial Sequence: Synthetic polypeptide
QVQLVESGGGVVQPGRSLRLSCAASGFTFSSYSIHWVRQAPGKGLEWVAVISDDASMKFYADSVKGRFTISRDNSKNTLFLQMNSLSPEDTAVYYCARDALTAISVRFDYWGQGTLVTVSS

SEQ ID NO: 3332 - protein, 14 aa, Artificial Sequence
  Description of Artificial Sequence: Synthetic peptide
ARDALTAISVRFDY

SEQ ID NO: 3333 - protein, 108 aa, Artificial Sequence
  Description of Artificial Sequence: Synthetic polypeptide
DIQMTQSPSSLSASVGDRVTITCRASQSISRYLNWYQQKPGKAPKLLIYDASSFQSGVPSRFSGSGSGTDFTLTISSLQPEDFATYYCQQSYSTPSVTFGGGTKVEIK

SEQ ID NO: 3334 - protein, 10 aa, Artificial Sequence
  Description of Artificial Sequence: Synthetic peptide
QQSYSTPSVT

SEQ ID NO: 3335 - protein, 122 aa, Artificial Sequence
  Description of Artificial Sequence: Synthetic polypeptide
QVQLVQSGAEVKKPGASVKVSCKASGYTFTSFYMHWVRQAPGQGLEWMGIINPSGGATTYAQKFQGRVTMTSDASTSTLYMELSSLRSDDTAVYYCTRDAGFIPTDNWFDPWGQGTLVTVSS

SEQ ID NO: 3336 - protein, 15 aa, Artificial Sequence
  Description of Artificial Sequence: Synthetic peptide
TRDAGFIPTDNWFDP

SEQ ID NO: 3337 - protein, 111 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGRSALGMCSFGQGTKLEIK

SEQ ID NO: 3338 - protein, 12 aa, Artificial Sequence
  Description of Artificial Sequence: Synthetic peptide
QQYGRSALGMCS

SEQ ID NO: 3339 - protein, 123 aa, Artificial Sequence
  Description of Artificial Sequence: Synthetic polypeptide
  MOD_RES (53)..(53): Any amino acid
QVQLVESGGGVVQPGRSLRLSCAASGFTFSSYDMHWVRQAPGKGLEWVVVISXDGSSKFYADSVKGRFTISRDNSKNTLYLQMNSLRAEDTAVYYCARDPPGEISTTPVLDYWGQGTLVTVSS

SEQ ID NO: 3340 - protein, 16 aa, Artificial Sequence
  Description of Artificial Sequence: Synthetic peptide
ARDPPGEISTTPVLDY

SEQ ID NO: 3341 - protein, 108 aa, Artificial Sequence
  Description of Artificial Sequence: Synthetic polypeptide
DIQMTQSPSSLAASVGDRVTITCRASQSISNYLNWYQQKPGKAPNLLIYAASSLQSGVPSRFSGSGSGTDFTLTISSLQPEDFATYYCQQSYSTPPLTFGGGTKVEIK

SEQ ID NO: 3342 - protein, 10 aa, Artificial Sequence
  Description of Artificial Sequence: Synthetic peptide
QQSYSTPPLT

SEQ ID NO: 3343 - protein, 124 aa, Artificial Sequence
  Description of Artificial Sequence: Synthetic polypeptide
EVQLVESGGGLVKPGGSLRLSCAASGFTFSNAWMSWVRQAPGKGLEWVGHIKSKTDGGTTDYATPVKGRFTISRDDSKNTLYLQMNSLKSEDTAVYFCSTSDLIYYYSYGMDVWGQGTTVTVSS

SEQ ID NO: 3344 - protein, 15 aa, Artificial Sequence
  Description of Artificial Sequence: Synthetic peptide
STSDLIYYYSYGMDV

SEQ ID NO: 3345 - protein, 108 aa, Artificial Sequence
  Description of Artificial Sequence: Synthetic polypeptide
DIQMTQSPSTLSASVGDRVTITCRASQSISSWLAWYQQKPGKAPKLLIYKASTLQSGVPSRFSGSGSGTEFTLTISSLQPDDFATYYCQQYNSYSSYTFGQGTKLEIK

SEQ ID NO: 3346 - protein, 10 aa, Artificial Sequence
  Description of Artificial Sequence: Synthetic peptide
QQYNSYSSYT

SEQ ID NO: 3347 - protein, 131 aa, Artificial Sequence; identical to SEQ ID NO: 115
  Description of Artificial Sequence: Synthetic polypeptide

SEQ ID NO: 3348 - protein, 24 aa, Artificial Sequence
  Description of Artificial Sequence: Synthetic peptide
AREDFILVSAPIRENSYYYYGMDV

SEQ ID NO: 3349 - protein, 108 aa, Artificial Sequence; identical to SEQ ID NO: 116
  Description of Artificial Sequence: Synthetic polypeptide

SEQ ID NO: 3350 - protein, 9 aa, Artificial Sequence
  Description of Artificial Sequence: Synthetic peptide
QQYGGSPRT

SEQ ID NO: 3351 - protein, 129 aa, Artificial Sequence
  Description of Artificial Sequence: Synthetic polypeptide
EVQLVESGGGLVKPGGSLRLSCAASGFPFTNAWMSWVRQAPGKGLEWVGHIKDYTDGGTTDYAAPVKGRFTISRDDSKNTLYLHMNSLKTEDTAVYYCSTVGSYYYDSRGPTSDAFDIWGQGTMVTVSS

SEQ ID NO: 3352 - protein, 20 aa, Artificial Sequence
  Description of Artificial Sequence: Synthetic peptide
STVGSYYYDSRGPTSDAFDI

SEQ ID NO: 3353 - protein, 113 aa, Artificial Sequence
  Description of Artificial Sequence: Synthetic polypeptide
DIVMTQSPDSLAMSLGERATINCKSSQSVLYSSNKKNYLAWYRQKPGQPPKLLIYWASTRESGVPDRFSGSGSGTDFTLTISSLQAEDVAVYYCQQYYSTPYTFGQGTKLEIK

SEQ ID NO: 3354 - protein, 9 aa, Artificial Sequence
  Description of Artificial Sequence: Synthetic peptide
QQYYSTPYT

SEQ ID NO: 3355 - protein, 128 aa, Artificial Sequence
  Description of Artificial Sequence: Synthetic polypeptide
QVQLVQSGAEVKKPGSSVKVSCKASGGTFNSYAISWVRQAPGQGLEWMGGIIPIFGTANYAQKFQGRVTITADESTGMAYMELSSLRSEDTAVYYCARVGAPMSRVRGYYYYYGMDVWGPGTTVTVSS

SEQ ID NO: 3356 - protein, 21 aa, Artificial Sequence
  Description of Artificial Sequence: Synthetic peptide
ARVGAPMSRVRGYYYYYGMDV

SEQ ID NO: 3357 - protein, 111 aa, Artificial Sequence
  Description of Artificial Sequence: Synthetic polypeptide
DIVMTQSPLSLPVTPGEPASISCRSSQSLLQSNGNSFLDWYLQKPGQSPQLLIYLGSNRASGVPDRFSGSGSGTDFTLKISRVEAEDVGVYYCMQALQRCSFGQGTKLEIK

SEQ ID NO: 3358 - protein, 8 aa, Artificial Sequence
  Description of Artificial Sequence: Synthetic peptide
MQALQRCS

SEQ ID NO: 3359 - protein, 123 aa, Artificial Sequence
  Description of Artificial Sequence: Synthetic polypeptide
EVQLLESGGGLVQPGGSLRLSCAASGFTFSSYAMNWVRQAPGKGLEWVSAISGSGGGTYYADSVKGRFTISRDNSKNTLYLQMDSLRAEDTAVYYCAKDVPIEQQLVPTFDYWGQGALVTVSS

SEQ ID NO: 3360 - protein, 16 aa, Artificial Sequence
  Description of Artificial Sequence: Synthetic peptide
AKDVPIEQQLVPTFDY

SEQ ID NO: 3361 - protein, 108 aa, Artificial Sequence
  Description of Artificial Sequence: Synthetic polypeptide
DIQMTQSPSSLSASVGDRVTITCRASQSISRYLNWYQQKPGKAPKLLIYGASSLQSGVPSRFSGSGSGTDFTLTISSLQPEDFATYWCQQSYSTLSITFGQGTRLEIK

SEQ ID NO: 3362 - protein, 10 aa, Artificial Sequence
  Description of Artificial Sequence: Synthetic peptide
QQSYSTLSIT

SEQ ID NO: 3363 - protein, 127 aa, Artificial Sequence
  Description of Artificial Sequence: Synthetic polypeptide
EVQLLESGGGLVQPGGSLRLSCAASGFTFNNYAMNWVRQAPGRGLEWVSGISGSGANTYYADSVKGRFTISRDNPKNTLSLQMNSLRAEDTALYYCAKVLSPTYYDSWSGPDAFDFWGQGTMVTVTS

SEQ ID NO: 3364 - protein, 20 aa, Artificial Sequence
  Description of Artificial Sequence: Synthetic peptide
AKVLSPTYYDSWSGPDAFDF

SEQ ID NO: 3365 - protein, 108 aa, Artificial Sequence; identical to SEQ ID NO: 106
  Description of Artificial Sequence: Synthetic polypeptide

SEQ ID NO: 3366 - protein, 10 aa, Artificial Sequence
  Description of Artificial Sequence: Synthetic peptide
QQYNSYSSWT

SEQ ID NO: 3367 - protein, 118 aa, Artificial Sequence
  Description of Artificial Sequence: Synthetic polypeptide
QVQLQESGPGLVKSSETLSLSCTVSGGSISSHYWSWIRQPAGKALEWIGRLYTSGSTAYNPSLKSRVTMSVDTSKNQFSLKLTSVTAADTAVYYCAREPNYHYHGMDVWGQGTTVTVS

SEQ ID NO: 3368 - protein, 13 aa, Artificial Sequence
  Description of Artificial Sequence: Synthetic peptide
AREPNYHYHGMDV

SEQ ID NO: 3369 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQGNSFLLTFGGGTKVEIK

SEQ ID NO: 3370 - protein, 9 aa, Artificial Sequence
  Description of Artificial Sequence: Synthetic peptide
QQGNSFLLT

SEQ ID NO: 3371 - protein, 122 aa, Artificial Sequence
  Description of Artificial Sequence: Synthetic polypeptide
QVQLVQSGAEVKKPGASVKVSCKASGYTFTDSYMHWVRQAPGQGLEWMGIINPSGGSTTYAQKFQGRVTMTRDTSTSKVYMELSSLRSEDTAVYYCARDAFYIPAGGWFDPWGQGTLVTVSS

SEQ ID NO: 3372 - protein, 15 aa, Artificial Sequence
  Description of Artificial Sequence: Synthetic peptide
ARDAFYIPAGGWFDP

SEQ ID NO: 3373 - protein, 108 aa, Artificial Sequence
  Description of Artificial Sequence: Synthetic polypeptide
EIVLTQSPGTLSLSPGERATLSCRASQSVSSSYFAWYQQKPGQAPRLLIYGASSRATGIPDRFSGSGSGTDFTLTISRLEPEDVAVYYCQQYGSSSRTFGQGTKVEIK

SEQ ID NO: 3374 - protein, 9 aa, Artificial Sequence
  Description of Artificial Sequence: Synthetic peptide
QQYGSSSRT

SEQ ID NO: 3375 - protein, 122 aa, Artificial Sequence
  Description of Artificial Sequence: Synthetic polypeptide
QVQLVQSGAEVKKPGASVKVSCKASGYTFSDHYIYWVRQAPGQGLEWMGIINPSAGSTSYAQKFQGRVTMTRDTSTSTVYMELSSLRSEDTAVYYCARDIVFVPATMAMDVWGLGTTVTVSS

SEQ ID NO: 3376 - protein, 15 aa, Artificial Sequence
  Description of Artificial Sequence: Synthetic peptide
ARDIVFVPATMAMDV

SEQ ID NO: 3377 - protein, 107 aa, Artificial Sequence
  Description of Artificial Sequence: Synthetic polypeptide
EIVLTQSPATLSLSPGERATLSCRASQSVSRYLAWYQQKPGQAPRLLIYDASNRATGIPARFSGSGSGTDFTLTISSLEPEDFAVYYCQQRSNWLFTFGPGTKVDIK

SEQ ID NO: 3378 - protein, 9 aa, Artificial Sequence
  Description of Artificial Sequence: Synthetic peptide
QQRSNWLFT

SEQ ID NO: 3379 - protein, 120 aa, Artificial Sequence
  Description of Artificial Sequence: Synthetic polypeptide
QVQLVQSGAEVKKPGSSVKVSCKASGDTSSSYGINWVRQAPGQGLEWMGEIIPMFETTNYAQKFQGRVTITADESTSTAYMELSSLRSEDTAVYYCARDPGYGNHDLDFWGQGTLVTVSS

SEQ ID NO: 3380 - protein, 13 aa, Artificial Sequence
  Description of Artificial Sequence: Synthetic peptide
ARDPGYGNHDLDF

SEQ ID NO: 3381 - protein, 103 aa, Artificial Sequence
  Description of Artificial Sequence: Synthetic polypeptide
DIQMTQSPSSLSASVGDRVTITCRASQGISSWLAWYQQKPGKAPKLLIYSASSLQSGVPSRFSGSGSGTNFTLTISSLQPEDFATYYCQQARTFGPGTKVDIK

SEQ ID NO: 3382 - protein, 5 aa, Artificial Sequence
  Description of Artificial Sequence: Synthetic peptide
QQART

SEQ ID NO: 3383 - protein, 118 aa, Artificial Sequence
  Description of Artificial Sequence: Synthetic polypeptide
EVQLVESGGGLVQPGGSLRLSCTASGFIVSSNYMSWVRQAPGKGLEWVSVLYSGGSTFYADSVKGRFTISRDNSKNTLYLQMNSLRSDDTAVYYCARDLRGPGKFDYWGQGTLVSVSS

SEQ ID NO: 3384 - protein, 12 aa, Artificial Sequence
  Description of Artificial Sequence: Synthetic peptide
ARDLRGPGKFDY

SEQ ID NO: 3385 - protein, 108 aa, Artificial Sequence
  Description of Artificial Sequence: Synthetic polypeptide
DIQMTQSPSSLSASVGDRVTITCQASQGISNSLNWYQQKPGKAPKLLIYDASNLETGVPSRFSGSGSGTDFTFTISSLQPEDIATYYCQQYDNLPEVTFGQGTRLEIK

SEQ ID NO: 3386 - protein, 10 aa, Artificial Sequence
  Description of Artificial Sequence: Synthetic peptide
QQYDNLPEVT

SEQ ID NO: 3387 - protein, 127 aa, Artificial Sequence
  Description of Artificial Sequence: Synthetic polypeptide
QVQLQESGPGLVKPSETLSLTCSVSGGSIFTHCWSWIRQPPGKGLEWIGNIYFSGKTNYNASLKSRVTISVDTSKNQFSLKLSSVTTADTAVYYCARALTYNDILTGGEYFNGMDVWGQGTTVTVSS

SEQ ID NO: 3388 - protein, 21 aa, Artificial Sequence
  Description of Artificial Sequence: Synthetic peptide
ARALTYNDILTGGEYFNGMDV

SEQ ID NO: 3389 - protein, 107 aa, Artificial Sequence
  Description of Artificial Sequence: Synthetic polypeptide
DIQMTQSPSSLSASVGDRVTITCRASQDIRNDLGWYHQKPGKAPRRLIYAASSLQSGVPSRFSGSGSGTEFTLTISSLQPEDFATYYCLQHNSYPWTFGQGTKVEIK

SEQ ID NO: 3390 - protein, 9 aa, Artificial Sequence
  Description of Artificial Sequence: Synthetic peptide
LQHNSYPWT

SEQ ID NO: 3391 - protein, 117 aa, Artificial Sequence
  Description of Artificial Sequence: Synthetic polypeptide
EVQLVESGGGLIQPGGSLRLSCAASGVIVRSNYMSWVRQAPGKGLEWVALIYSGGTTDYADSVKGRFTISRDNSKNTLYLQMDSLRAEDTAVYYCARDLIVYGMDVWGQGTTVTVSS

SEQ ID NO: 3392 - protein, 11 aa, Artificial Sequence
  Description of Artificial Sequence: Synthetic peptide
ARDLIVYGMDV

SEQ ID NO: 3393 - protein, 108 aa, Artificial Sequence
  Description of Artificial Sequence: Synthetic polypeptide
DIQLTQSPSFLSASVGDRVTITCRASQGISSFLAWYQQKPGKAPKLLIYGASTLQSGVPSRFSGSGSGTEFTLTISSLQPEDFATYYCQQLNSYPMCSFGQGTKLEIK

SEQ ID NO: 3394 - protein, 10 aa, Artificial Sequence
  Description of Artificial Sequence: Synthetic peptide
QQLNSYPMCS

SEQ ID NO: 3395 - protein, 124 aa, Artificial Sequence; identical to SEQ ID NO: 157
  Description of Artificial Sequence: Synthetic polypeptide

SEQ ID NO: 3396 - protein, 17 aa, Artificial Sequence
  Description of Artificial Sequence: Synthetic peptide
ARPLLPGETGNLNRLDY

SEQ ID NO: 3397 - protein, 107 aa, Artificial Sequence; identical to SEQ ID NO: 158
  Description of Artificial Sequence: Synthetic polypeptide
  MOD_RES (45)..(45): Any amino acid

SEQ ID NO: 3398 - protein, 9 aa, Artificial Sequence
  Description of Artificial Sequence: Synthetic peptide
QQSYSTLWT

SEQ ID NO: 3399 - protein, 115 aa, Artificial Sequence
  Description of Artificial Sequence: Synthetic polypeptide
EVQLVESGGGLVQPGGSLRLSCAASGIIVSSNYMNWVRQVPGKGLEWVSVLYSGGSTFYADSVRGRFTISRDNSKNTLFLQMNSLRPEDTAVYYCARDFREGAFDIWGQGTMVTV

SEQ ID NO: 3400 - protein, 11 aa, Artificial Sequence
  Description of Artificial Sequence: Synthetic peptide
ARDFREGAFDI

SEQ ID NO: 3401 - protein, 107 aa, Artificial Sequence
  Description of Artificial Sequence: Synthetic polypeptide
DIQLTQSPSFLSASVGDRVTITCRASQGISSYLAWYQQKPGKAPNLLIYAASTLQSGVPSRFSGSGSGTDFTLTISSLQPEDFATYYCQQLNSYSPLFGQGTRLEIK

SEQ ID NO: 3402 - protein, 9 aa, Artificial Sequence
  Description of Artificial Sequence: Synthetic peptide
QQLNSYSPL

SEQ ID NO: 3403 - protein, 127 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSGSTYYNPSLKSRVIISVDTSKNHFSLKLNSVTAADTAVYYCARDRPNYYFDSRDAFDIWGQGTMVTVSS

SEQ ID NO: 3404 - protein, 17 aa, Artificial Sequence
  Description of Artificial Sequence: Synthetic peptide
ARDRPNYYFDSRDAFDI

SEQ ID NO: 3405 - protein, 113 aa, Artificial Sequence
  Description of Artificial Sequence: Synthetic polypeptide
DIVMTQSPDSLAVSLGERATINCKSGQSLLYSSNNKNYLAWYQQKPGQPPKLLIYWASTRESGVPDQFSGSGSGTDFTLTISSLQAEDVAVYYCQQYYSTPRTFGQGTKVEIK

SEQ ID NO: 3406 - protein, 9 aa, Artificial Sequence
  Description of Artificial Sequence: Synthetic peptide
QQYYSTPRT

SEQ ID NO: 3407 - protein, 121 aa, Artificial Sequence
  Description of Artificial Sequence: Synthetic polypeptide
EVQLVESGGGLVQPGRSLRLSCAASGFTFDDYALHWVRQAPGKGLEWVSGISWNGDSIGYADSVKGRFTISRDNAKNSLSLQMNSLTAEDTAFYYCARGVEYSSSSNCDFWGQGTLVTVSS

SEQ ID NO: 3408 - protein, 14 aa, Artificial Sequence
  Description of Artificial Sequence: Synthetic peptide
ARGVEYSSSSNCDF

SEQ ID NO: 3409 - protein, 106 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSETDFTLTISSLQPEDFATYYCQQTNSFPLTFGGGTKVEI

SEQ ID NO: 3410 - protein, 9 aa, Artificial Sequence
  Description of Artificial Sequence: Synthetic peptide
QQTNSFPLT

SEQ ID NO: 3411 - protein, 118 aa, Artificial Sequence
  Description of Artificial Sequence: Synthetic polypeptide
EVQLVESGGGLAQPGRSLRLSCAASGFMFDDYTMHWVRQAPGKGLEWVSGISWNSENIGYADSVKGRFTISRDNAKNSLFLQINSLRADDTAFYYCVREEVGGWFDPWGQGTLVAVSS

SEQ ID NO: 3412 - protein, 11 aa, Artificial Sequence
  Description of Artificial Sequence: Synthetic peptide
VREEVGGWFDP

SEQ ID NO: 3413 - protein, 113 aa, Artificial Sequence; identical to SEQ ID NO: 3285
  Description of Artificial Sequence: Synthetic polypeptide

SEQ ID NO: 3414 - protein, 10 aa, Artificial Sequence
  Description of Artificial Sequence: Synthetic peptide
SQSTHVPPWT

SEQ ID NO: 3415 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSYKHYADSVKGRFAISRDNSKNTLHLQMNSLRAEDTAVYYCARDSNVDTVMVTWFDYWGQGTLVTVSS

SEQ ID NO: 3416 - protein, 16 aa, Artificial Sequence
  Description of Artificial Sequence: Synthetic peptide
ARDSNVDTVMVTWFDY

SEQ ID NO: 3417 - protein, 107 aa, Artificial Sequence
  Description of Artificial Sequence: Synthetic polypeptide
DIQMTQSPSSLSASVGDRVTITCRASQSISSYLNWYQQKPGKAPKLLIYVASSLQSGVPSRFSGSGSGTDFTLTISSLQPEDFATYYCQQSYSTPPWTFGQGTKVEI

SEQ ID NO: 3418 - protein, 10 aa, Artificial Sequence
  Description of Artificial Sequence: Synthetic peptide
QQSYSTPPWT

SEQ ID NO: 3419 - protein, 124 aa, Artificial Sequence
  Description of Artificial Sequence: Synthetic polypeptide
EVQLVESGGGLVQPGGSLRLSCAASGFTFSSDDMHWVRQATGKGLEWVSAIGTSGDTYYSGSVKGRFTISRENAKNSFYLQMNSLRAGDTAVYYCARGVITSLDGNYYYYMDVWGQGTTVTVSS

SEQ ID NO: 3420 - protein, 18 aa, Artificial Sequence
  Description of Artificial Sequence: Synthetic peptide
ARGVITSLDGNYYYYMDV

SEQ ID NO: 3421 - protein, 108 aa, Artificial Sequence
  Description of Artificial Sequence: Synthetic polypeptide
DIQMTQSPSSLSASVGDRVTITCRASQNIRFYLNWYQQKPGKAPNLLIYAASNLQSGVPSRFSGGGSGTDFTLTISSLQPEDFATYYCQQSYSSPPWTFGPGTKVEIK

SEQ ID NO: 3422 - protein, 10 aa, Artificial Sequence
  Description of Artificial Sequence: Synthetic peptide
QQSYSSPPWT

SEQ ID NO: 3423 - protein, 128 aa, Artificial Sequence
  Description of Artificial Sequence: Synthetic polypeptide
QVQLVQSGAELKKPGSSLKVSCKASGGTFSSSAISWVRQAPGQGLEWMGGIIPSLTTANYAQRFQDKVTITADISTSTVYMELSSLRSEDTAIYYCAKGPRLHDSLWGSFRFDAFDIWGQGTMVTVSS

SEQ ID NO: 3424 - protein, 21 aa, Artificial Sequence
  Description of Artificial Sequence: Synthetic peptide
AKGPRLHDSLWGSFRFDAFDI

SEQ ID NO: 3425 - protein, 113 aa, Artificial Sequence
  Description of Artificial Sequence: Synthetic polypeptide
DIVMTQTPLSLPVTPGEPASISCRSSQSLLDSDYGNTYLDWYLQKPGQSPQLLIYTLSYRASGVPDRFSGSGSGTDFTLKISRVEAEDVGVYYCMQRMDFPYSFGQGTKLEIK

SEQ ID NO: 3426 - protein, 9 aa, Artificial Sequence
  Description of Artificial Sequence: Synthetic peptide
MQRMDFPYS

SEQ ID NO: 3427 - protein, 129 aa, Artificial Sequence
  Description of Artificial Sequence: Synthetic polypeptide
EVQLVESGGGLVKPGGSLRLSCAASGFPFTNAWMSWVRQAPGKGLEWVGHIKDYTDGGTTDYAAPVKGKFTISRDDSKNTLYLHMNSLKTEDTAVYYCSTVGSYYYDSRGPTSDAFDIWGQGTMVTVSS

SEQ ID NO: 3428 - protein, 20 aa, Artificial Sequence
  Description of Artificial Sequence: Synthetic peptide
STVGSYYYDSRGPTSDAFDI

SEQ ID NO: 3429 - protein, 113 aa, Artificial Sequence; identical to SEQ ID NO: 170
  Description of Artificial Sequence: Synthetic polypeptide

SEQ ID NO: 3430 - protein, 9 aa, Artificial Sequence
  Description of Artificial Sequence: Synthetic peptide
QQYYSTPYT

SEQ ID NO: 3431 - protein, 120 aa, Artificial Sequence
  Description of Artificial Sequence: Synthetic polypeptide
QVQLVESGGGMVQPGRSLRLSCAASGFTFNNYAMHWVRQALGKGPEWVAAISSDGRTKTYTDSVKGRFTISRDNSENTLYLQMNSVRAEDTALYYCAKDSVGIVDYFDYWGQGTLVTVSS

SEQ ID NO: 3432 - protein, 13 aa, Artificial Sequence
  Description of Artificial Sequence: Synthetic peptide
AKDSVGIVDYFDY

SEQ ID NO: 3433 - protein, 108 aa, Artificial Sequence
  Description of Artificial Sequence: Synthetic polypeptide
DIQMTQSPSSLSASVGDRVTITCRASQIISNYLNWYQQKPGKAPKLLIFAASSLQSGVPSRFSASGSGTDFTLTISSLQPEDFATYYCQQSYSTPPYTFGQGTKLEIK

SEQ ID NO: 3434 - protein, 10 aa, Artificial Sequence
  Description of Artificial Sequence: Synthetic peptide
QQSYSTPPYT

SEQ ID NO: 3435 - protein, 120 aa, Artificial Sequence; identical to SEQ ID NO: 111
  Description of Artificial Sequence: Synthetic polypeptide

SEQ ID NO: 3436 - protein, 13 aa, Artificial Sequence
  Description of Artificial Sequence: Synthetic peptide
ARLSERWYSPFDS

SEQ ID NO: 3437 - protein, 110 aa, Artificial Sequence; identical to SEQ ID NO: 112
  Description of Artificial Sequence: Synthetic polypeptide

SEQ ID NO: 3438 - protein, 12 aa, Artificial Sequence
  Description of Artificial Sequence: Synthetic peptide
QQYNNWPPGGFT

SEQ ID NO: 3439 - protein, 130 aa, Artificial Sequence
  Description of Artificial Sequence: Synthetic polypeptide
EVQLVESGGGLVKPGGSLRLSCAASGLTFSHAWMSWVRQAPGKGLEWVGRIKSKIDGGTTDYAAPVKGRFTISRDDSKSTQYLQMNSLKTEDTAVYYCTTDCFWRLRGTSCYEHDAFDIWGQGTMVTVSS

SEQ ID NO: 3440 - protein, 21 aa, Artificial Sequence
  Description of Artificial Sequence: Synthetic peptide
TTDCFWRLRGTSCYEHDAFDI

SEQ ID NO: 3441 - protein, 106 aa, Artificial Sequence
  Description of Artificial Sequence: Synthetic polypeptide
DIQMTQSPSSLSASVGDRVTITCRASQTIASFLNWYQQKPGKAPKLLIYAASSLQSGVPSRFSGSGSGTDFTLTISSLQPEDFATYYCQQSYNSLHFGGGTQVEIK

SEQ ID NO: 3442 - protein, 8 aa, Artificial Sequence
  Description of Artificial Sequence: Synthetic peptide
QQSYNSLH

SEQ ID NO: 3443 - protein, 124 aa, Artificial Sequence; identical to SEQ ID NO: 161
  Description of Artificial Sequence: Synthetic polypeptide

SEQ ID NO: 3444 - protein, 17 aa, Artificial Sequence
  Description of Artificial Sequence: Synthetic peptide
ARVPSSSDYGDYGGFEY

SEQ ID NO: 3445 - protein, 107 aa, Artificial Sequence; identical to SEQ ID NO: 162
  Description of Artificial Sequence: Synthetic polypeptide

SEQ ID NO: 3446 - protein, 9 aa, Artificial Sequence
  Description of Artificial Sequence: Synthetic peptide
QQSYSTPCS

SEQ ID NO: 3447 - protein, 123 aa, Artificial Sequence
  Description of Artificial Sequence: Synthetic polypeptide
QVQLVESGGGVVQPGKSLRLSCAASGFTFRSYAMHWVRQAPGKGLEWVAVIWDDGSSKHYSDSVKGHFTISRDNSKNTLYLQMNSLRAEDTAVYYCARDSNVDTVMVTWFDYWGQGTLVTVSS

SEQ ID NO: 3448 - protein, 16 aa, Artificial Sequence
  Description of Artificial Sequence: Synthetic peptide
ARDSNVDTVMVTWFDY

SEQ ID NO: 3449 - protein, 108 aa, Artificial Sequence; identical to SEQ ID NO: 168
  Description of Artificial Sequence: Synthetic polypeptide

SEQ ID NO: 3450 - protein, 10 aa, Artificial Sequence
  Description of Artificial Sequence: Synthetic peptide
QQSYSTPPWT

SEQ ID NO: 3451 - protein, 125 aa, Artificial Sequence
  Description of Artificial Sequence: Synthetic polypeptide
QVQLQQWGAGLLKPSATLSLTCAVYGASFSGYSWSWIRQPPGRGLEWVGEINHSGGTNYNPSLKSRVTISADTSKNQFSLKLSSVTAADTAVYYCATTRSELRYFGYNYYGVDVWGQGTAVSVSS

SEQ ID NO: 3452 - protein, 19 aa, Artificial Sequence
  Description of Artificial Sequence: Synthetic peptide
ATTRSELRYFGYNYYGVDV

SEQ ID NO: 3453 - protein, 107 aa, Artificial Sequence
  Description of Artificial Sequence: Synthetic polypeptide
DIQMTQSPSSLSASVEDRVTITCRASQGIRNDLGWYQQKPGKAPKRLIYAASSLQSGVPSRFSGSGSGTEFTLTISSLQPEDSATYYCLQYNTYPRTFGQGTKVEIK

SEQ ID NO: 3454 - protein, 9 aa, Artificial Sequence
  Description of Artificial Sequence: Synthetic peptide
LQYNTYPRT

SEQ ID NO: 3455 - protein, 125 aa, Artificial Sequence
  Description of Artificial Sequence: Synthetic polypeptide
QVQLVESGGGVVLPGRSLRLSCAASGLTFSTYGMHWVRQAPGKGLEWVAVISNDGSNKYYADSVKGRFTISRDNSKNTLYLQMNSLRAEDTALYYCAKDFFMYYSGWYRYYIDYWGQGTLVTVSS

SEQ ID NO: 3456 - protein, 18 aa, Artificial Sequence
  Description of Artificial Sequence: Synthetic peptide
AKDFFMYYSGWYRYYIDY

SEQ ID NO: 3457 - protein, 107 aa, Artificial Sequence
  Description of Artificial Sequence: Synthetic polypeptide
DIQMTQSPSSLSASLGDRVTITCQASQDISNFLNWYQQKPGRAPKLLIYDASNLETGVPSRFSGSGSGTDFTFTISSLQPEDIATYYCQQYDNLPLTFGGGTKVEIK

SEQ ID NO: 3458 - protein, 9 aa, Artificial Sequence
  Description of Artificial Sequence: Synthetic peptide
QQYDNLPLT

SEQ ID NO: 3459 - protein, 117 aa, Artificial Sequence
  Description of Artificial Sequence: Synthetic polypeptide
EVQLVESGGGLIQRGGSLRLSCAASGLTVSSNYMTWVRQAPGTGLEWVSVIYSGGSTFYADSVKGRFTISRDNSKNTLYLQMNSLRPEDTAVYYCARDRGESGLDVWGQGTTVTVSS

SEQ ID NO: 3460 - protein, 11 aa, Artificial Sequence
  Description of Artificial Sequence: Synthetic peptide
ARDRGESGLDV

SEQ ID NO: 3461 - protein, 106 aa, Artificial Sequence
  Description of Artificial Sequence: Synthetic polypeptide
DIQMTQSPSFVSASVGDRVTITCRASQGISRWLAWYQQKPGKAPKLLIYAASSLQSGVPSRFSGSGSGTDFTLTISSLQPEDFATYYCQQANSFPLFGGGTKVEIK

SEQ ID NO: 3462 - protein, 8 aa, Artificial Sequence
  Description of Artificial Sequence: Synthetic peptide
QQANSFPL

SEQ ID NO: 3463 - protein, 122 aa, Artificial Sequence
  Description of Artificial Sequence: Synthetic polypeptide
QVQLVQSGAEVKKPGASVKVSCKASGYTFTGSYMHWVRQAPGQGLEWMGWINPNSGGTNYAQKFQGRVTMTRDTSISTAYMELSSLRSDDTAVYFCARFGSGWQWLGKTDVWGQGTTVTVSS

SEQ ID NO: 3464 - protein, 15 aa, Artificial Sequence
  Description of Artificial Sequence: Synthetic peptide
ARFGSGWQWLGKTDV

SEQ ID NO: 3465 - protein, 108 aa, Artificial Sequence
  Description of Artificial Sequence: Synthetic polypeptide
DIQMTQSPSSLSASVGDRVTITCQASQDISTYLNWYQQKPGKAPKLLIYDASNLETGVPSRFSGSGSGTDFTFTISSLQPEDIATYYCQQYDNLPQYTFGQGTKLEIK

SEQ ID NO: 3466 - protein, 10 aa, Artificial Sequence
  Description of Artificial Sequence: Synthetic peptide
QQYDNLPQYT

SEQ ID NO: 3467 - protein, 121 aa, Artificial Sequence; identical to SEQ ID NO: 125
  Description of Artificial Sequence: Synthetic polypeptide

SEQ ID NO: 3468 - protein, 14 aa, Artificial Sequence
  Description of Artificial Sequence: Synthetic peptide
AKGVEYSSSSNCDY

SEQ ID NO: 3469 - protein, 106 aa, Artificial Sequence; identical to SEQ ID NO: 126
  Description of Artificial Sequence: Synthetic polypeptide

SEQ ID NO: 3470 - protein, 9 aa, Artificial Sequence
  Description of Artificial Sequence: Synthetic peptide
QQTNSFPLT

SEQ ID NO: 3471 - protein, 126 aa, Artificial Sequence
  Description of Artificial Sequence: Synthetic polypeptide
EVQLLESGGGLEQPGGSLRLSCAASGFTFSTYAMSWVRQAPGKGLEWVSAISGSGAGTFYADSVKGRFTISRDNSKNTLYLQMNSLRAEDTAVYYCARESDCGSTSCYQVGWFDPWGQGTLVTVSS

SEQ ID NO: 3472 - protein, 19 aa, Artificial Sequence
  Description of Artificial Sequence: Synthetic peptide
ARESDCGSTSCYQVGWFDP

SEQ ID NO: 3473 - protein, 108 aa, Artificial Sequence; identical to SEQ ID NO: 2885
  Description of Artificial Sequence: Synthetic polypeptide

SEQ ID NO: 3474 - protein, 10 aa, Artificial Sequence
  Description of Artificial Sequence: Synthetic peptide
QQSYSTPPWT

SEQ ID NO: 3475 - protein, 121 aa, Artificial Sequence
  Description of Artificial Sequence: Synthetic polypeptide
EVQLVESGGGLVQPGRSLRLSCAASGFTFDDYAMHWVRQAPGKGLEWVSGISWNSDSIGYADSVKGRFTISRDNAKNSLYLQMNSLTAEDTALYYCAKGVEYSSSSNFDYWGQGTLVTVSS

SEQ ID NO: 3476 - protein, 14 aa, Artificial Sequence
  Description of Artificial Sequence: Synthetic peptide
AKGVEYSSSSNFDY

SEQ ID NO: 3477 - protein, 106 aa, Artificial Sequence
  Description of Artificial Sequence: Synthetic polypeptide
DIQMTQSPSSVSASVGDRVTITCRASQGISSWLAWYQQKPGKAPKLLIYTASGLQSGVPSRFSGSGSETDFTLTISSLQPEDFATYYCQQTNSFPLTFGGGTKVEI

SEQ ID NO: 3478 - protein, 9 aa, Artificial Sequence
  Description of Artificial Sequence: Synthetic peptide
QQTNSFPLT

SEQ ID NO: 3479 - protein, 124 aa, Artificial Sequence
  Description of Artificial Sequence: Synthetic polypeptide
QVQLVQSGAEVKKPGASVKVSCKASGHTFTSYYMHWVRQAPGQGLEWMGIINPSGGSTSYAQKFQGRVTMTRDTSTSTVYMELSSLRSEDTAVYYCARGPERGIVGATDYFDYWGQGTLVTVSS

SEQ ID NO: 3480 - protein, 17 aa, Artificial Sequence
  Description of Artificial Sequence: Synthetic peptide
ARGPERGIVGATDYFDY

SEQ ID NO: 3481 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYVSSPWTFGQGTKVEIK

SEQ ID NO: 3482 - protein, 9 aa, Artificial Sequence
  Description of Artificial Sequence: Synthetic peptide
QQYVSSPWT

SEQ ID NO: 3483 - protein, 117 aa, Artificial Sequence
  Description of Artificial Sequence: Synthetic polypeptide
EVQLVESGGGLVQPGGSLRLSCAASGFTVSSNYMSWVRQAPGKGLEWVSLIYSGGSTYYADSVKGRFTISRDNSKNTLYLQMNSLRAEDTAVYYCARDTLGRGGDYWGQGTLVTVSS

SEQ ID NO: 3484 - protein, 11 aa, Artificial Sequence
  Description of Artificial Sequence: Synthetic peptide
ARDTLGRGGDY

SEQ ID NO: 3485 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPRSFGQGTKLEIK

SEQ ID NO: 3486 - protein, 9 aa, Artificial Sequence
  Description of Artificial Sequence: Synthetic peptide
QQYDNLPRS

SEQ ID NO: 3487 - protein, 120 aa, Artificial Sequence
  Description of Artificial Sequence: Synthetic polypeptide
QVQLVESGGGVVQPGRSLRLSCAASGFTFSNYGMHWVRQAPGKGLEWVAVIWYDGSNKHYADSVKGRFTISRDNSKNTLYLQMNSLRAEDTAEYYCARDMGTLVTHFDYWGQGTLVTVSS

SEQ ID NO: 3488 - protein, 13 aa, Artificial Sequence
  Description of Artificial Sequence: Synthetic peptide
ARDMGTLVTHFDY

SEQ ID NO: 3489 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASNLQSGVPSRFSGSGSGTDFTLTISSLQPEDFATYYCQQSYSSPPWTFGQGTKVEIK

SEQ ID NO: 3490 - protein, 10 aa, Artificial Sequence
  Description of Artificial Sequence: Synthetic peptide
QQSYSSPPWT

SEQ ID NO: 3491 - protein, 121 aa, Artificial Sequence
  Description of Artificial Sequence: Synthetic polypeptide
EVQLVESGGGLVQPGGSLRLSCAASGFIFSSYDMHWVRQATGKGLEWVSTIGTAGDTYYPDSVKGRFTISRENAKNSLYLQMNSLRAGDTAVYYCARGDYNILTGYYFDYWGQGTLVTVSS

SEQ ID NO: 3492 - protein, 15 aa, Artificial Sequence
  Description of Artificial Sequence: Synthetic peptide
ARGDYNILTGYYFDY

SEQ ID NO: 3493 - protein, 108 aa, Artificial Sequence
  Description of Artificial Sequence: Synthetic polypeptide
DIQMTQSPSSLSASVGDRVTITCRASQSISSYLNWYQQKPGKAPNLLIYAASSLQSGVPSRFSGSGSGTDFTLTISSLQPEDFATYYCQQSYNTPQVTFGGGTKVESK

SEQ ID NO: 3494 - protein, 10 aa, Artificial Sequence
  Description of Artificial Sequence: Synthetic peptide
QQSYNTPQVT

SEQ ID NO: 3495 - protein, 124 aa, Artificial Sequence; identical to SEQ ID NO: 159
  Description of Artificial Sequence: Synthetic polypeptide

SEQ ID NO: 3496 - protein, 17 aa, Artificial Sequence
  Description of Artificial Sequence: Synthetic peptide
ARVPSSSDYGDYGGFEY

SEQ ID NO: 3497 - protein, 107 aa, Artificial Sequence; identical to SEQ ID NO: 160
  Description of Artificial Sequence: Synthetic polypeptide

SEQ ID NO: 3498 - protein, 9 aa, Artificial Sequence
  Description of Artificial Sequence: Synthetic peptide
QQSYSTPCS

SEQ ID NO: 3499 - protein, 120 aa, Artificial Sequence; identical to SEQ ID NO: 1195
  Description of Artificial Sequence: Synthetic polypeptide

SEQ ID NO: 3500 - protein, 13 aa, Artificial Sequence
  Description of Artificial Sequence: Synthetic peptide
TRDDSSWPHFFDN

SEQ ID NO: 3501 - protein, 107 aa, Artificial Sequence
  Description of Artificial Sequence: Synthetic polypeptide
DIQMTQSPSSLSASVGDRVTIPCRASQNIDNYLNWYQQKPGKAPKLLIFAASGLQDEAPSRFSGVGSGTDFTLTISSLQPEDSATYYCQQSYISPYTFGRGTKLEIK

SEQ ID NO: 3502 - protein, 9 aa, Artificial Sequence
  Description of Artificial Sequence: Synthetic peptide
QQSYISPYT

SEQ ID NO: 3503 - protein, 124 aa, Artificial Sequence; identical to SEQ ID NO: 155
  Description of Artificial Sequence: Synthetic polypeptide

SEQ ID NO: 3504 - protein, 17 aa, Artificial Sequence
  Description of Artificial Sequence: Synthetic peptide
ARPLLPGETGSLNRLDY

SEQ ID NO: 3505 - protein, 107 aa, Artificial Sequence; identical to SEQ ID NO: 156
  Description of Artificial Sequence: Synthetic polypeptide

SEQ ID NO: 3506 - protein, 9 aa, Artificial Sequence
  Description of Artificial Sequence: Synthetic peptide
QQSYSTLWT

SEQ ID NO: 3507 - protein, 120 aa, Artificial Sequence; identical to SEQ ID NO: 145
  Description of Artificial Sequence: Synthetic polypeptide

SEQ ID NO: 3508 - protein, 13 aa, Artificial Sequence
  Description of Artificial Sequence: Synthetic peptide
ARLSDRWYSPFDP

SEQ ID NO: 3509 - protein, 110 aa, Artificial Sequence; identical to SEQ ID NO: 146
  Description of Artificial Sequence: Synthetic polypeptide

SEQ ID NO: 3510 - protein, 12 aa, Artificial Sequence
  Description of Artificial Sequence: Synthetic peptide
QQYNNWPPGGFT

SEQ ID NO: 3511 - protein, 121 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCVKGVEYSSSSNFDYWGQGTLVTVSS

SEQ ID NO: 3512 - protein, 14 aa, Artificial Sequence
  Description of Artificial Sequence: Synthetic peptide
VKGVEYSSSSNFDY

SEQ ID NO: 3513 - protein, 106 aa, Artificial Sequence; identical to SEQ ID NO: 3477
  Description of Artificial Sequence: Synthetic polypeptide

SEQ ID NO: 3514 - protein, 9 aa, Artificial Sequence
  Description of Artificial Sequence: Synthetic peptide
QQTNSFPLT

SEQ ID NO: 3515 - protein, 117 aa, Artificial Sequence
  Description of Artificial Sequence: Synthetic polypeptide
EVQLVESGGGLVQPGGSLRLSCAASGFTVSSNYMSWVRQAPGKGLEWVSLIYSGGSTYYADSVKGRFTISRDNSKNTLYLQMNSLRAEDTAVYYCARDTFGRGGDYWGQGTLVTVSS

SEQ ID NO: 3516 - protein, 11 aa, Artificial Sequence
  Description of Artificial Sequence: Synthetic peptide
ARDTFGRGGDY

SEQ ID NO: 3517 - protein, 107 aa, Artificial Sequence; identical to SEQ ID NO: 3485
  Description of Artificial Sequence: Synthetic polypeptide

SEQ ID NO: 3518 - protein, 9 aa, Artificial Sequence
  Description of Artificial Sequence: Synthetic peptide
QQYDNLPRS

SEQ ID NO: 3519 - protein, 117 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTFYADSVKGRFTFSRDNSKNTLYLQMNSLRAEDTAVYYCARDLMAYGMDVWGQGTTVTVSS

SEQ ID NO: 3520 - protein, 11 aa, Artificial Sequence
  Description of Artificial Sequence: Synthetic peptide
ARDLMAYGMDV

SEQ ID NO: 3521 - protein, 108 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNSYPQGTFGGGTKVEIK

SEQ ID NO: 3522 - protein, 10 aa, Artificial Sequence
  Description of Artificial Sequence: Synthetic peptide
QQLNSYPQGT

SEQ ID NO: 3523 - protein, 122 aa, Artificial Sequence
  Description of Artificial Sequence: Synthetic polypeptide
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGDSGSYLGVWYFDLWGRGTLVTVSS

SEQ ID NO: 3524 - protein, 16 aa, Artificial Sequence
  Description of Artificial Sequence: Synthetic peptide
ARGDSGSYLGVWYFDL

SEQ ID NO: 3525 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSSPPITFGPGTKVDIK

SEQ ID NO: 3526 - protein, 10 aa, Artificial Sequence
  Description of Artificial Sequence: Synthetic peptide
QQSYSSPPIT

SEQ ID NO: 3527 - protein, 117 aa, Artificial Sequence
  Description of Artificial Sequence: Synthetic polypeptide
EVQLVESGGGLVKPGGSLRLSCAASGFTVRSYSMNWVRQAPGKGLEWVSCMTSSGSYLYYADSVKGRFTISRDNAKNSLYLQMNSLRDEDTAVYYCAKEEYYGMDVWGQGATVTVSS

SEQ ID NO: 3528 - protein, 10 aa, Artificial Sequence
  Description of Artificial Sequence: Synthetic peptide
AKEEYYGMDV

SEQ ID NO: 3529 - protein, 107 aa, Artificial Sequence
  Description of Artificial Sequence: Synthetic polypeptide
DIQMTQSPSSLSASVGDRVTITCRASQDISSWLAWYQQKPGKAPKLLIYAASNLQSGVPSRFSGSGSGTHFTLTISSLQPEDFVTYYCQQANRFPITFGQGTRLEIK

SEQ ID NO: 3530 - protein, 9 aa, Artificial Sequence
  Description of Artificial Sequence: Synthetic peptide
QQANRFPIT

SEQ ID NO: 3531 - protein, 118 aa, Artificial Sequence
  Description of Artificial Sequence: Synthetic polypeptide
QVQLVQSGAEVKKPGSSVKVSCKASGGTFSSNAISWVRQAPGQGLEWMGGITPIFGTVNYAQKFQGRVTITADESTSTAYMELSSLRSEDTAVYYCASEWEIFGFDYWGQGTLVTVSS

SEQ ID NO: 3532 - protein, 11 aa, Artificial Sequence
  Description of Artificial Sequence: Synthetic peptide
ASEWEIFGFDY

SEQ ID NO: 3533 - protein, 107 aa, Artificial Sequence
  Description of Artificial Sequence: Synthetic polypeptide
DIQMTQSPSSLSASVGDRVTITCRASQSISRYLNWYQQKSGKAPKLLIYAASSLQSGVPSRFSGSGSGTDFTLTISSLQPEDFATYYCQQSYSTPWTFGQGTKVEIK

SEQ ID NO: 3534 - protein, 9 aa, Artificial Sequence
  Description of Artificial Sequence: Synthetic peptide
QQSYSTPWT

SEQ ID NO: 3535 - protein, 118 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLPPRRFDIWGQGTMVTVSS

SEQ ID NO: 3536 - protein, 11 aa, Artificial Sequence
  Description of Artificial Sequence: Synthetic peptide
ARDLPPRRFDI

SEQ ID NO: 3537 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQFDNLPITFGQGTRLEIK

SEQ ID NO: 3538 - protein, 9 aa, Artificial Sequence
  Description of Artificial Sequence: Synthetic peptide
QQFDNLPIT

SEQ ID NO: 3539 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEPIGQPLLWWDYWGQGTLVTVSS

SEQ ID NO: 3540 - protein, 14 aa, Artificial Sequence
  Description of Artificial Sequence: Synthetic peptide
AKEPIGQPLLWWDY

SEQ ID NO: 3541 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPRGFGQGTKVEIK

SEQ ID NO: 3542 - protein, 9 aa, Artificial Sequence
  Description of Artificial Sequence: Synthetic peptide
QQRSNWPRG

SEQ ID NO: 3543 - protein, 125 aa, Artificial Sequence; identical to SEQ ID NO: 171
  Description of Artificial Sequence: Synthetic polypeptide

SEQ ID NO: 3544 - protein, 18 aa, Artificial Sequence
  Description of Artificial Sequence: Synthetic peptide
ATERIAVAGTRMYNWFDP

SEQ ID NO: 3545 - protein, 108 aa, Artificial Sequence; identical to SEQ ID NO: 172
  Description of Artificial Sequence: Synthetic polypeptide

SEQ ID NO: 3546 - protein, 10 aa, Artificial Sequence
  Description of Artificial Sequence: Synthetic peptide
QQSYSAPPWT

SEQ ID NO: 3547 - protein, 122 aa, Artificial Sequence
  Description of Artificial Sequence: Synthetic polypeptide
EVQLVESGGGLVKPGGSLRVSCAASGFSFSYAWMSWVRQAPGKGLEWVGRIKSKTDGGTTDCAAPVKGRFTISRDDSKNTLYLQMNSLKTEDTAVYYCTTLSDYGDLSSVYWGQGTLVTVSS

SEQ ID NO: 3548 - protein, 13 aa, Artificial Sequence
  Description of Artificial Sequence: Synthetic peptide
TTLSDYGDLSSVY

SEQ ID NO: 3549 - protein, 107 aa, Artificial Sequence [sequence omitted]

SEQ ID NO: 3550 - protein, 9 aa, Artificial Sequence
  Description of Artificial Sequence: Synthetic peptide
QQSYSTPLT

SEQ ID NO: 3551 - protein, 115 aa, Artificial Sequence
  Description of Artificial Sequence: Synthetic polypeptide
EVQLVESGGGLIQPGGSLRLSCAASGLTVSRNYMNWVRQAPGKGLEWVSVMYSGGSTFYADSVKGRFTISRDNSKNTLYLQMNSLRAEDTAVYYCARESYGMDVWGQGTTVTVSS

SEQ ID NO: 3552 - protein, 9 aa, Artificial Sequence
  Description of Artificial Sequence: Synthetic peptide
ARESYGMDV

SEQ ID NO: 3553 - protein, 108 aa, Artificial Sequence
  Description of Artificial Sequence: Synthetic polypeptide
EIVLTQSPGTLSLSPGERATLSCRASQSFSSTYLAWYQQKPGQAPRLLIYGASSRATGIPDRFSGSGSGTDFTLTISRLEPEDFAVYYCQQYVTSPWTFGQGTKVEIK

SEQ ID NO: 3554 - protein, 9 aa, Artificial Sequence
  Description of Artificial Sequence: Synthetic peptide
QQYVTSPWT

SEQ ID NO: 3555 - protein, 128 aa, Artificial Sequence; identical to SEQ ID NO: 139
  Description of Artificial Sequence: Synthetic polypeptide

SEQ ID NO: 3556 - protein, 21 aa, Artificial Sequence
  Description of Artificial Sequence: Synthetic peptide
AKDTPGGDDILTGWGLYGMDV

SEQ ID NO: 3557 - protein, 107 aa, Artificial Sequence; identical to SEQ ID NO: 140
  Description of Artificial Sequence: Synthetic polypeptide

SEQ ID NO: 3558 - protein, 9 aa, Artificial Sequence
  Description of Artificial Sequence: Synthetic peptide
QQSYSTPWT

SEQ ID NO: 3559 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSAITDSGDGTFYADSVKGRFTISRDNSKNTLYLQMNSLRAEDTAVYYCASEEDYSNYVGWFDPWGQGTLVTVSS

SEQ ID NO: 3560 - protein, 15 aa, Artificial Sequence
  Description of Artificial Sequence: Synthetic peptide
ASEEDYSNYVGWFDP

SEQ ID NO: 3561 - protein, 108 aa, Artificial Sequence; identical to SEQ ID NO: 2885
  Description of Artificial Sequence: Synthetic polypeptide

SEQ ID NO: 3562 - protein, 10 aa, Artificial Sequence
  Description of Artificial Sequence: Synthetic peptide
QQSYSTPPWT

SEQ ID NO: 3563 - protein, 131 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARMVTSGTYYYDNSGYSSSGPFDYWGQGTLVTVSS

SEQ ID NO: 3564 - protein, 24 aa, Artificial Sequence
  Description of Artificial Sequence: Synthetic peptide
ARMVTSGTYYYDNSGYSSSGPFDY

SEQ ID NO: 3565 - protein, 103 aa, Artificial Sequence
  Description of Artificial Sequence: Synthetic polypeptide
AIQLTQSPSSLSASVGDRVTITCRASQGISSALAWYQQKPGKAPKLLIYDASSLESGVPSRFSGSGSGTDFTLTISSLQPEDFATYYCQQFNNFGPGTKVDIK

SEQ ID NO: 3566 - protein, 5 aa, Artificial Sequence
  Description of Artificial Sequence: Synthetic peptide
QQFNN

SEQ ID NO: 3567 - protein, 117 aa, Artificial Sequence
  Description of Artificial Sequence: Synthetic polypeptide
EVQLVESGGGLVQPGGSLRLSCAASGFTVSSNYMSWVRQAPGKGLEWVSLIYSGGSTYYADSVKGRFTISRDNSKNTLYLQMNTLRAEDTAVYYCARDTLGRGGDYWGQGTLVTVSS

SEQ ID NO: 3568 - protein, 11 aa, Artificial Sequence
  Description of Artificial Sequence: Synthetic peptide
ARDTLGRGGDY

SEQ ID NO: 3569 - protein, 107 aa, Artificial Sequence
  Description of Artificial Sequence: Synthetic polypeptide
DIQMTQSPSSLSASVGDRVTITCQASQDISNYLNWYQQKPGKAPKVLIYDASNLETGVPSRFSGSGSGTDFTFTISSLQPEDIATYFCQQYDNLPRSFGQGTKLEIK

SEQ ID NO: 3570 - protein, 9 aa, Artificial Sequence
  Description of Artificial Sequence: Synthetic peptide
QQYDNLPRS

SEQ ID NO: 3571 - protein, 129 aa, Artificial Sequence
  Description of Artificial Sequence: Synthetic polypeptide
EVQLVESGGGLVQPGRSLRLSCTASGFTFGDYAMNWFRQAPGKGLEWVGFIRSKAYGGTTEYAASVRGRFTISRDDSESIAYLQMNSLKTEDTAVYYCTRDLSYYYDSSGRGSHLFDYWGQGTLVTVSS

SEQ ID NO: 3572 - protein, 20 aa, Artificial Sequence
  Description of Artificial Sequence: Synthetic peptide
TRDLSYYYDSSGRGSHLFDY

SEQ ID NO: 3573 - protein, 106 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWWTFGQGTKVEIK

SEQ ID NO: 3574 - protein, 8 aa, Artificial Sequence
  Description of Artificial Sequence: Synthetic peptide
QQYNNWWT

SEQ ID NO: 3575 - protein, 121 aa, Artificial Sequence
  Description of Artificial Sequence: Synthetic polypeptide
QVQLVQSGAEVKKPGSSVKVSCKASGGTISSYAISWVRQAPGQGLEWMGGIIPIFGTTNYAQKFQGRVTITADESTSTAYMELSSLRSEDTALYYCARDDGQQLWSYFDYWGQGTLVTVSS

SEQ ID NO: 3576 - protein, 14 aa, Artificial Sequence
  Description of Artificial Sequence: Synthetic peptide
ARDDGQQLWSYFDY

SEQ ID NO: 3577 - protein, 114 aa, Artificial Sequence
  Description of Artificial Sequence: Synthetic polypeptide
DIVMTQSPDSLAVSLGERATINCKSSQSVLYSSNNKSYLAWYQQKPGQPPKLLIYWASTRESGVPDRFSGSGSGTDFTLTISSLQAEDVAVYYCQQYYSTLPLTFGGGTKVEIK

SEQ ID NO: 3578 - protein, 10 aa, Artificial Sequence
  Description of Artificial Sequence: Synthetic peptide
QQYYSTLPLT

SEQ ID NO: 3579 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYFCAKQLYYYGSGSYVFDYWGQGTLVTVSS

SEQ ID NO: 3580 - protein, 16 aa, Artificial Sequence
  Description of Artificial Sequence: Synthetic peptide
AKQLYYYGSGSYVFDY

SEQ ID NO: 3581 - protein, 107 aa, Artificial Sequence
  Description of Artificial Sequence: Synthetic polypeptide
DIQMTQSPSSLSASVGDRVTITCQASQDIRNFLNWYQQKPGKAPKLLIYDASNLETGVPSRFSGSGSGTDFTFTISSLQPEDIATYYCQQYDNLPLTFGGGTKVEIK

SEQ ID NO: 3582 - protein, 9 aa, Artificial Sequence
  Description of Artificial Sequence: Synthetic peptide
QQYDNLPLT

SEQ ID NO: 3583 - protein, 120 aa, Artificial Sequence
  Description of Artificial Sequence: Synthetic polypeptide
EVQLVESGGGLVQPGGSLRLSCAASGFNFSTHWMHWVRQAPGKGLVWVSRINSDGSRRAYATSVKGRFTISRDNAKNTLYLQMDSLRDEDTAVYYCTRDDSSWPHFFDNWGQGTLVAVSS

SEQ ID NO: 3584 - protein, 13 aa, Artificial Sequence
  Description of Artificial Sequence: Synthetic peptide
TRDDSSWPHFFDN

SEQ ID NO: 3585 - protein, 109 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPPKLTFGGGTKVEIK

SEQ ID NO: 3586 - protein, 11 aa, Artificial Sequence
  Description of Artificial Sequence: Synthetic peptide
QQYDNLPPKLT

SEQ ID NO: 3587 - protein, 123 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARASGLRSYYYYGMDVWGQGTTVTVSS

SEQ ID NO: 3588 - protein, 16 aa, Artificial Sequence
  Description of Artificial Sequence: Synthetic peptide
ARASGLRSYYYYGMDV

SEQ ID NO: 3589 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPATFGQGTKVEIK

SEQ ID NO: 3590 - protein, 9 aa, Artificial Sequence
  Description of Artificial Sequence: Synthetic peptide
QQSYSTPAT

SEQ ID NO: 3591 - protein, 125 aa, Artificial Sequence
  Description of Artificial Sequence: Synthetic polypeptide
QVQLVQSGAEVKKPGASVKVSCKASGSTFTGYYMHWVRQAPGQGLEWMGWINPNSGGTNYAQKFQGWVTMTRDTSISTAYMELSRLRSDDTAVYYCAREKVATMFALPPYGMDVWGQGTTVTVSS

SEQ ID NO: 3592 - protein, 18 aa, Artificial Sequence
  Description of Artificial Sequence: Synthetic peptide
AREKVATMFALPPYGMDV

SEQ ID NO: 3593 - protein, 108 aa, Artificial Sequence
  Description of Artificial Sequence: Synthetic polypeptide
EIVLTQSPATLSLSPGERATLSCRASQSVSSYLAWYQQKPGQTPRLLIYDASNRATGIPARFSGSGSGTDFTLTISSLEPEDFAVYYCQQRSNWPPIAFGQGTRLEIK

SEQ ID NO: 3594 - protein, 10 aa, Artificial Sequence
  Description of Artificial Sequence: Synthetic peptide
QQRSNWPPIA

SEQ ID NO: 3595 - protein, 126 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTTNHAQKFQGRVTITADESTSTAYMELSSLRSEDTAVYYCTSGQGAGVNRGVVITTLGYWGQGTLVTVSS

SEQ ID NO: 3596 - protein, 19 aa, Artificial Sequence
  Description of Artificial Sequence: Synthetic peptide
TSGQGAGVNRGVVITTLGY

SEQ ID NO: 3597 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPCSFGQGTKLEIK

SEQ ID NO: 3598 - protein, 9 aa, Artificial Sequence
  Description of Artificial Sequence: Synthetic peptide
QQYYSTPCS

SEQ ID NO: 3599 - protein, 118 aa, Artificial Sequence
  Description of Artificial Sequence: Synthetic polypeptide
EVQLVESGGGLVQPGGSLRLSCAASGFTFSSYDMHWVRQATGKGLQWVSAIGTAGDTYYPDSVKGRFTISRENAKNSLYLQMNSLRAGDTAVYYCARDRDSSWSFDYWGQGTLVTVSS

SEQ ID NO: 3600 - protein, 12 aa, Artificial Sequence
  Description of Artificial Sequence: Synthetic peptide
ARDRDSSWSFDY

SEQ ID NO: 3601 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGGGSGADFTLTISSLQPEDFATYYCQQSYSTPPITFGQGTRLEIK

SEQ ID NO: 3602 - protein, 10 aa, Artificial Sequence
  Description of Artificial Sequence: Synthetic peptide
QQSYSTPPIT

SEQ ID NO: 3603 - protein, 117 aa, Artificial Sequence
  Description of Artificial Sequence: Synthetic polypeptide
EVQLVESGGGLIQPGGSLRLSCAASGVIVSSNYMSWVRQAPGKGLEWVSVIYSGGSTYYADSVKGRFTISRDNSKNTLYLQMNSLRAEDTAVYYCARDGGHYGMDVWGQGTTVTVSS

SEQ ID NO: 3604 - protein, 11 aa, Artificial Sequence
  Description of Artificial Sequence: Synthetic peptide
ARDGGHYGMDV

SEQ ID NO: 3605 - protein, 107 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPAFGQGTRLEIK

SEQ ID NO: 3606 - protein, 9 aa, Artificial Sequence
  Description of Artificial Sequence: Synthetic peptide
QQLNSYPPA

SEQ ID NO: 3607 - protein, 121 aa, Artificial Sequence; identical to SEQ ID NO: 3511
  Description of Artificial Sequence: Synthetic polypeptide

SEQ ID NO: 3608 - protein, 14 aa, Artificial Sequence
  Description of Artificial Sequence: Synthetic peptide
VKGVEYSSSSNFDY

SEQ ID NO: 3609 - protein, 107 aa, Artificial Sequence
  Description of Artificial Sequence: Synthetic polypeptide
DIQMTQSPSSVSASVGDRVTITCRASQGISSWLAWYQQKPGKAPKLLIYVESSLQSGVPSRFSGSGSGTDFTLTISSLQPEDFATYYCQQANSFPLTFGGGTKVEIK

SEQ ID NO: 3610 - protein, 9 aa, Artificial Sequence
  Description of Artificial Sequence: Synthetic peptide
QQANSFPLT

SEQ ID NO: 3611 - protein, 129 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARRPRDYYDRSGYYYVPGYFDYWGQGTLVTVSS

SEQ ID NO: 3612 - protein, 22 aa, Artificial Sequence
  Description of Artificial Sequence: Synthetic peptide
ARRPRDYYDRSGYYYVPGYFDY

SEQ ID NO: 3613 - protein, 107 aa, Artificial Sequence; identical to SEQ ID NO: 2773
  Description of Artificial Sequence: Synthetic polypeptide

SEQ ID NO: 3614 - protein, 9 aa, Artificial Sequence
  Description of Artificial Sequence: Synthetic peptide
QQYDNLPLT

SEQ ID NO: 3615 - protein, 117 aa, Artificial Sequence
  Description of Artificial Sequence: Synthetic polypeptide
EVQLVESGGGLVQPGGSLRLSCAASGFIVSSNYMSWVRQAPGKGLEWVSVIYSGGSTYYADSVKGRFTISRDNSKNTLYLQMNSLRAEDTAVYYCARDYGDFYFDYWGQGTLVTVSS

SEQ ID NO: 3616 - protein, 11 aa, Artificial Sequence
  Description of Artificial Sequence: Synthetic peptide
ARDYGDFYFDY

SEQ ID NO: 3617 - protein, 107 aa, Artificial Sequence; identical to SEQ ID NO: 1565
  Description of Artificial Sequence: Synthetic polypeptide

SEQ ID NO: 3618 - protein, 9 aa, Artificial Sequence
  Description of Artificial Sequence: Synthetic peptide
QQYNNWPRT

SEQ ID NO: 3619 - protein, 122 aa, Artificial Sequence
  Description of Artificial Sequence: Synthetic polypeptide
EVQLVESGGGLVQPGGSLRLSCAASGFTFSSYDMHWVRQATGKGLEWVSAIGTAGDTYYPDSVKGRFTISRENAKNSLYLQMNSLRAGDTAVYYCARDRGSSGWYGWYFDLWGRGTLVTVSS

SEQ ID NO: 3620 - protein, 16 aa, Artificial Sequence
  Description of Artificial Sequence: Synthetic peptide
ARDRGSSGWYGWYFDL

SEQ ID NO: 3621 - protein, 108 aa, Artificial Sequence
  Description of Artificial Sequence: Synthetic polypeptide
DIQMTQSPSSLSASVGDRVTITCRASQSISSYLNWYQQKPGKAPKLLIYVASSLQSGVPSRFSGSGSGTDFTLTISSLQPEDFATYYCQQSYSTPPITFGQGTRLEIK

SEQ ID NO: 3622 - protein, 10 aa, Artificial Sequence
  Description of Artificial Sequence: Synthetic peptide
QQSYSTPPIT

SEQ ID NO: 3623 - protein, 121 aa, Artificial Sequence; identical to SEQ ID NO: 3539
  Description of Artificial Sequence: Synthetic polypeptide

SEQ ID NO: 3624 - protein, 14 aa, Artificial Sequence
  Description of Artificial Sequence: Synthetic peptide
AKEPIGQPLLWWDY

SEQ ID NO: 3625 - protein, 107 aa, Artificial Sequence; identical to SEQ ID NO: 3541
  Description of Artificial Sequence: Synthetic polypeptide

SEQ ID NO: 3626 - protein, 9 aa, Artificial Sequence
  Description of Artificial Sequence: Synthetic peptide
QQRSNWPRG

SEQ ID NO: 3627 - protein, 123 aa, Artificial Sequence
  Description of Artificial Sequence: Synthetic polypeptide
EVQLVESGGGLVQPGGSLRLSCAASGFTFTNYNMNWVRQAPGKGLEWVSYISSSSSTIYYADSVKGRFTISRDNAKNSLYLQMNSLRDEDTAVYYCARVVGSGSYYYYGMDVWGQGTTVTVSS

SEQ ID NO: 3628 - protein, 16 aa, Artificial Sequence
  Description of Artificial Sequence: Synthetic peptide
ARVVGSGSYYYYGMDV

SEQ ID NO: 3629 - protein, 107 aa, Artificial Sequence
  Description of Artificial Sequence: Synthetic polypeptide
DIQMTQSPSSLSASVGDRVTITCRASQSISSYLNWYQQKPGKAPKLLIYGASSLQSGVPSRFSGSGSGTDFTLTISSLQPEDFATYYCQQSYSTPATFGQGTKLEIK

SEQ ID NO: 3630 - protein, 9 aa, Artificial Sequence
  Description of Artificial Sequence: Synthetic peptide
QQSYSTPAT

SEQ ID NO: 3631 - protein, 123 aa, Artificial Sequence
  Description of Artificial Sequence: Synthetic polypeptide
EVQLVESGGGLVQPGGSLRLSCAASGFTFSSYDMHWVRQASGKGLEWVSAIGTSGDTYYPGSVKGRFTISRENAKNSLYLQMNSLRAGDTAVYYCARGTFFYGSGSYNWFDPWGQGTLVTVSS

SEQ ID NO: 3632 - protein, 17 aa, Artificial Sequence
  Description of Artificial Sequence: Synthetic peptide
ARGTFFYGSGSYNWFDP

SEQ ID NO: 3633 - protein, 108 aa, Artificial Sequence; identical to SEQ ID NO: 2885
  Description of Artificial Sequence: Synthetic polypeptide

SEQ ID NO: 3634 - protein, 10 aa, Artificial Sequence
  Description of Artificial Sequence: Synthetic peptide
QQSYSTPPWT

SEQ ID NO: 3635 - protein, 119 aa, Artificial Sequence
  Description of Artificial Sequence: Synthetic polypeptide
EVQLVQSGAEVKKPGESLKISCKGSGYTFTSYWIGWVRQMPGKGLEWMGFIYPGDSDTRYSPSFQGQVTISADKSISTAYLQWSSLKASDTAMYYCARPVTYDWYFDLWGRGTLVTVSS

SEQ ID NO: 3636 - protein, 12 aa, Artificial Sequence
  Description of Artificial Sequence: Synthetic peptide
ARPVTYDWYFDL

SEQ ID NO: 3637 - protein, 107 aa, Artificial Sequence
  Description of Artificial Sequence: Synthetic polypeptide
DIQMTQSPSSVSASLGDRVTITCRASQGISSWLAWYQQKPGKAPKVLIYAASSLQSGVPSRFSGSGSGTDFTLTISSLQPEDFATYYCQQANSFPITFGQGTRLEIK

SEQ ID NO: 3638 - protein, 9 aa, Artificial Sequence
  Description of Artificial Sequence: Synthetic peptide
QQANSFPIT

SEQ ID NO: 3639 - protein, 126 aa, Artificial Sequence; identical to SEQ ID NO: 3471
  Description of Artificial Sequence: Synthetic polypeptide

SEQ ID NO: 3640 - protein, 19 aa, Artificial Sequence
  Description of Artificial Sequence: Synthetic peptide
ARESDCGSTSCYQVGWFDP

SEQ ID NO: 3641 - protein, 108 aa, Artificial Sequence; identical to SEQ ID NO: 2885
  Description of Artificial Sequence: Synthetic polypeptide

SEQ ID NO: 3642 - protein, 10 aa, Artificial Sequence
  Description of Artificial Sequence: Synthetic peptide
QQSYSTPPWT

SEQ ID NO: 3643 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAAIWYDGSNKHYADSVKGRFTISRDNSKNTLYLQMNSLRAEDTAVYYCARDVGRVTTWFDPWGQGTLVTVSS

SEQ ID NO: 3644 - protein, 13 aa, Artificial Sequence
  Description of Artificial Sequence: Synthetic peptide
ARDVGRVTTWFDP

SEQ ID NO: 3645 - protein, 108 aa, Artificial Sequence
  Description of Artificial Sequence: Synthetic polypeptide
DIQMTQSPSSLSASVGDRVTITCRASQSISSYLTWYQQKPGKAPKLLIYAASSLQSGVPSRFSGSGSGTDFTLTISSLQPEDFATYYCQQSYSTPPWTFGQGTKVEIK

SEQ ID NO: 3646 - protein, 10 aa, Artificial Sequence
  Description of Artificial Sequence: Synthetic peptide
QQSYSTPPWT

SEQ ID NO: 3647 - protein, 122 aa, Artificial Sequence
  Description of Artificial Sequence: Synthetic polypeptide
QVQLVQSGAEVKKPGASVKVSCKASGYTFTAYYIHWVRQAPGQGLEWMGWISPISGGTKYAQKFQGRVTMTRDTSITTTYMDLSRLRSDDTAVYYCARDLKAVAISGDIDYWGQGTLVTVSS

SEQ ID NO: 3648 - protein, 15 aa, Artificial Sequence
  Description of Artificial Sequence: Synthetic peptide
ARDLKAVAISGDIDY

SEQ ID NO: 3649 - protein, 110 aa, Artificial Sequence
  Description of Artificial Sequence: Synthetic polypeptide
QSVLTQPASVSGSPGQSITISCTGTSSDVESYNLVSWYQQYPGKAPKLMIYEGSKRPSGLSNRFSGSKSGNTASLTISGLQAEDEADYYCFSYAGSNTWVFGGGTKLTVL

SEQ ID NO: 3650 - protein, 10 aa, Artificial Sequence
  Description of Artificial Sequence: Synthetic peptide
FSYAGSNTWV

SEQ ID NO: 3651 - protein, 120 aa, Artificial Sequence
  Description of Artificial Sequence: Synthetic polypeptide
EVQLVQSGAEVKRPGESLKISCKTSGYSFTSHWIGWVRQMPGKGLEWMGIIYPGDYDTRYNPSFQGQVTISADKSINTAFLQWSSLKASDSAIYYCSRRQGSYPPYFDYWGQGALVTVSS

SEQ ID NO: 3652 - protein, 13 aa, Artificial Sequence
  Description of Artificial Sequence: Synthetic peptide
SRRQGSYPPYFDY

SEQ ID NO: 3653 - protein, 108 aa, Artificial Sequence
  Description of Artificial Sequence: Synthetic polypeptide
SYVLTQPPSVSVAPGKTARITCGGNNIGSKRVHWYQQKPGQAPVLVISYDSDRPSGIPERFSGSNSGNTATLTISRVEAGDEADYYCQVWDSNSDYYVFGTGTKVTVL

SEQ ID NO: 3654 - protein, 11 aa, Artificial Sequence
  Description of Artificial Sequence: Synthetic peptide
QVWDSNSDYYV

SEQ ID NO: 3655 - protein, 125 aa, Artificial Sequence; identical to SEQ ID NO: 301
  Description of Artificial Sequence: Synthetic polypeptide

SEQ ID NO: 3656 - protein, 18 aa, Artificial Sequence
  Description of Artificial Sequence: Synthetic peptide
ARYKGTTVNTNYYYGMDV

SEQ ID NO: 3657 - protein, 106 aa, Artificial Sequence
  Description of Artificial Sequence: Synthetic polypeptide
SYVLTQPPSVSVSPGQTASITCSGDKLRNKYACWYQQKAGQSPMLVIYQDTKRPSGIPERFSGSNSGNTATLTISGTQAMDEADYYCQAWDISTVVFGGGTKLTVL

SEQ ID NO: 3658 - protein, 9 aa, Artificial Sequence
  Description of Artificial Sequence: Synthetic peptide
QAWDISTVV

SEQ ID NO: 3659 - protein, 123 aa, Artificial Sequence
  Description of Artificial Sequence: Synthetic polypeptide
EVQLVQSGAEVKKPGESLKISCKGSGYSFTSYWIGWVRQMPGKGLEWMGIFFPGNSDARYSPSFQGQVIMSADKSISTAYLQWSSLRASDTAMYYCARNGMHYGSGSYYNGFDPWGQGTLVTV

SEQ ID NO: 3660 - protein, 18 aa, Artificial Sequence
  Description of Artificial Sequence: Synthetic peptide
ARNGMHYGSGSYYNGFDP

SEQ ID NO: 3661 - protein, 110 aa, Artificial Sequence
  Description of Artificial Sequence: Synthetic polypeptide
QSVLTQPPSASGTPGQRVTISCSGSSSNIGSNTVNWYQQLPGTAPKLLIHSNNQRPSGVPDRFSGSKSGTSASLAISGLQSEDEGDYYCATWDDSLSGVVFGGGAKVTVL

SEQ ID NO: 3662 - protein, 11 aa, Artificial Sequence
  Description of Artificial Sequence: Synthetic peptide
ATWDDSLSGVV

SEQ ID NO: 3663 - protein, 124 aa, Artificial Sequence
  Description of Artificial Sequence: Synthetic polypeptide
QVQLVESGGGVVQPGRSLRLSCAASGFIFSSYGMHWVRQAPGKGLEWVAVISYDGSKKYYADSVKGRFTISRDNSKNTLYLQMNSLRAEDTAVHYCAKDQGYGDFYYYFGMDVWGQGTTVTVSS

SEQ ID NO: 3664 - protein, 17 aa, Artificial Sequence
  Description of Artificial Sequence: Synthetic peptide
AKDQGYGDFYYYFGMDV

SEQ ID NO: 3665 - protein, 109 aa, Artificial Sequence
  Description of Artificial Sequence: Synthetic polypeptide
QSALTQPPSVSGSPGQSVTISCTGTSSDVGSYNRVSWYQQPPGTAPKLMIYEVTNRPSGVPDRFSGSKSGNTASLTISGLQAEDEADYYCSSYTSSSLIFGGGTKLTVL

SEQ ID NO: 3666 - protein, 9 aa, Artificial Sequence
  Description of Artificial Sequence: Synthetic peptide
SSYTSSSLI

SEQ ID NO: 3667 - protein, 118 aa, Artificial Sequence
  Description of Artificial Sequence: Synthetic polypeptide
QVQLQESGPGLVKPSETLSLTCTVSGDSISSYFWSWIRQPPGRGLEWIGYIHDSVNTNYNPSLKSRVTISVDTSKSQFSLRLSSVTAADTAVYYCARCAWLRGSFDYWGQGTMVTVSS

SEQ ID NO: 3668 - protein, 12 aa, Artificial Sequence
  Description of Artificial Sequence: Synthetic peptide
ARCAWLRGSFDY

SEQ ID NO: 3669 - protein, 111 aa, Artificial Sequence; identical to SEQ ID NO: 288
  Description of Artificial Sequence: Synthetic polypeptide

SEQ ID NO: 3670 - protein, 10 aa, Artificial Sequence
  Description of Artificial Sequence: Synthetic peptide
QSYDFSSHYV

SEQ ID NO: 3671 - protein, 128 aa, Artificial Sequence
  Description of Artificial Sequence: Synthetic polypeptide
EVQLVESGGGLVQPGGSLRLSCAASGFIFSRYWMHWVRQAPGKGLVWVSRINSDGSNTTYADSVKGRFTISRDNAKNTLYLQMNSLRAEDTAVYYCARDLEYYDFWSGLSGDWSFDLWGRGTLVTVSS

SEQ ID NO: 3672 - protein, 21 aa, Artificial Sequence
  Description of Artificial Sequence: Synthetic peptide
ARDLEYYDFWSGLSGDWSFDL

SEQ ID NO: 3673 - protein, 109 aa, Artificial Sequence
  Description of Artificial Sequence: Synthetic polypeptide
QSVLTQPPSVSGAPGQRVTISCTGSSSNIGAGYDVQWYQQLPGTAPKLLIYGNSNRPSGVPDRFSGSKSGTSASLAITGLQAEDEASYYCQSYDSSLEVFGTGTKVTVL

SEQ ID NO: 3674 - protein, 9 aa, Artificial Sequence
  Description of Artificial Sequence: Synthetic peptide
QSYDSSLEV

SEQ ID NO: 3675 - protein, 129 aa, Artificial Sequence
  Description of Artificial Sequence: Synthetic polypeptide
EVQLVQSGAEVKKPGESLKISCKGSGYRFTSYWIGWVRQMPGKGLEWMAIIFPGDSETRYSPSFQGQVTISADKSISTAYLQWSSLKASDTAMYYCARLLHYYDRSGYSGATDDAFDIWGQGTMVTVSS

SEQ ID NO: 3676 - protein, 22 aa, Artificial Sequence
  Description of Artificial Sequence: Synthetic peptide
ARLLHYYDRSGYSGATDDAFDI

SEQ ID NO: 3677 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGLVLFGGGTKLTVL

SEQ ID NO: 3678 - protein, 12 aa, Artificial Sequence
  Description of Artificial Sequence: Synthetic peptide
QSYDSSLSGLVL

SEQ ID NO: 3679 - protein, 123 aa, Artificial Sequence
  Description of Artificial Sequence: Synthetic polypeptide
EVQLLESGGGLVQPGGSLRLSCAASGFTFSSYVMSWVRQAPGKGLEWVSGISGSGGSPYYADSVKGRFTISRDNSKNTLYLQMNSLRAEDTAVYYCAKDGDIVVALNDGFDIWGQGTMVTVSS

SEQ ID NO: 3680 - protein, 16 aa, Artificial Sequence
  Description of Artificial Sequence: Synthetic peptide
AKDGDIVVALNDGFDI

SEQ ID NO: 3681 - protein, 109 aa, Artificial Sequence
  Description of Artificial Sequence: Synthetic polypeptide
SYVLTQPPSVSVAPRKTARITCGGHNIGSKNVHWYQQRPGQAPVLVIYSDSDRPSGIPERFSGSNSGNTATLTISRIEAGDEADYYCQVWDGSSDHPVIFGGGTKLTVL

SEQ ID NO: 3682 - protein, 12 aa, Artificial Sequence
  Description of Artificial Sequence: Synthetic peptide
QVWDGSSDHPVI

SEQ ID NO: 3683 - protein, 117 aa, Artificial Sequence; identical to SEQ ID NO: 259
  Description of Artificial Sequence: Synthetic polypeptide

SEQ ID NO: 3684 - protein, 11 aa, Artificial Sequence
  Description of Artificial Sequence: Synthetic peptide
ARGDGELIFDQ

SEQ ID NO: 3685 - protein, 110 aa, Artificial Sequence; identical to SEQ ID NO: 260
  Description of Artificial Sequence: Synthetic polypeptide

SEQ ID NO: 3686 - protein, 10 aa, Artificial Sequence
  Description of Artificial Sequence: Synthetic peptide
QSYDSNLYAV

SEQ ID NO: 3687 - protein, 117 aa, Artificial Sequence
  Description of Artificial Sequence: Synthetic polypeptide
EVQLVESGGGLIQPGGSLRLSCAASGFSVSSNFMSWVRQAPGKGLEWVSLIYTGGSTYYADSVKGRFTISRDNSNNTLYLQMNSLRADDTAVYYCARTLGWWELDPWGQGTLVTVSS

SEQ ID NO: 3688 - protein, 11 aa, Artificial Sequence
  Description of Artificial Sequence: Synthetic peptide
ARTLGWWELDP

SEQ ID NO: 3689 - protein, 110 aa, Artificial Sequence
  Description of Artificial Sequence: Synthetic polypeptide
QSVLTQPPSVSGVPRQRVTISCSGSNSNIGNNAVNWYQQLPGKAPKLLIYYNDLLPSGFSDRFSGSKSGTSASLAISGLQSEDEADYYCAAWDDSLNGPVFGGGTKVTVL

SEQ ID NO: 3690 - protein, 11 aa, Artificial Sequence
  Description of Artificial Sequence: Synthetic peptide
AAWDDSLNGPV

SEQ ID NO: 3691 - protein, 122 aa, Artificial Sequence
  Description of Artificial Sequence: Synthetic polypeptide
QVQLQESGPGLVKPSQTLSLTCTVSGGSISSGGYHWSWIRQHPGKGLEWIGYIYYSGNTYYNPSLKSRVTMSLDTSKSQFSLNLSSVTAADTAVYYCARFDVFIPADAFDIWGQGTLVTVSS

SEQ ID NO: 3692 - protein, 14 aa, Artificial Sequence
  Description of Artificial Sequence: Synthetic peptide
ARFDVFIPADAFDI

SEQ ID NO: 3693 - protein, 109 aa, Artificial Sequence
  Description of Artificial Sequence: Synthetic polypeptide
QFVLTQPRSVSGSPGQSVTISCTGTSSDVGGYNYVSWYQQHPGKVPKLLTYDVSKRPSGVPDRFSGSKSGNTASLTISGLQAEDEADYYCCSYAGTYTVVFGGGTKVTV

SEQ ID NO: 3694 - protein, 10 aa, Artificial Sequence
  Description of Artificial Sequence: Synthetic peptide
CSYAGTYTVV

SEQ ID NO: 3695 - protein, 125 aa, Artificial Sequence
  Description of Artificial Sequence: Synthetic polypeptide
QLQLQESGPGLVKPSETLSLTCTVSGGSISSSNDYWGWIRQPPGKGLEWIGSIFYSGITYYNPSLESRVTISVDTSKNQFSLKLSSVTAADTAVFYCARLIRYCSTTSCYSFDFWGQGTLVTVSS

SEQ ID NO: 3696 - protein, 17 aa, Artificial Sequence
  Description of Artificial Sequence: Synthetic peptide
ARLIRYCSTTSCYSFDF

SEQ ID NO: 3697 - protein, 110 aa, Artificial Sequence
  Description of Artificial Sequence: Synthetic polypeptide
QSVLTQPASVSGSPGQSITISCTGTTSDVGSYNLVSWYQQHPGKAPKVMIFEVDKRPSGVSNRFSGSKSGNTASLTISGLQAEDEADYYCCSYVGSSSVIFGGGTKLTVL

SEQ ID NO: 3698 - protein, 10 aa, Artificial Sequence
  Description of Artificial Sequence: Synthetic peptide
CSYVGSSSVI

SEQ ID NO: 3699 - protein, 122 aa, Artificial Sequence
  Description of Artificial Sequence: Synthetic polypeptide
QVQLQESGPGLVKPSQTLSLTCTVSGGSISSGGYYWTWIRQYPGEGLEWIGYIYHSGSAYYNPSLKSRVTMSVDTSKNQFSLKLSSVTAADTAVYYCARAIVVVTLNWFDPWGQGTLVSVSS

SEQ ID NO: 3700 - protein, 14 aa, Artificial Sequence
  Description of Artificial Sequence: Synthetic peptide
ARAIVVVTLNWFDP

SEQ ID NO: 3701 - protein, 111 aa, Artificial Sequence
  Description of Artificial Sequence: Synthetic polypeptide
NFMLTQPHSVSESPGKTVTISCTGSSGSIASNYVQWYQQRPGSAPTAVIYEDNQRPSGVPDRFSGSIDSSSNSASLTISGLKTEDEADYYCQSYDSSNPVVFGGGTKLTVL

SEQ ID NO: 3702 - protein, 10 aa, Artificial Sequence
  Description of Artificial Sequence: Synthetic peptide
QSYDSSNPVV

SEQ ID NO: 3703 - protein, 119 aa, Artificial Sequence
  Description of Artificial Sequence: Synthetic polypeptide
QVQLVESGGGLVKPGGSLRLSCAVSGIDFTDYFMSWVRQAPGKGLEWISYIRSGNSYTDYADSVKGRFTISTDNAKNSLYLQMNSLRAEDTAVYYCASAPWLRGHFDYWGQGALVTVSS

SEQ ID NO: 3704 - protein, 12 aa, Artificial Sequence
  Description of Artificial Sequence: Synthetic peptide
ASAPWLRGHFDY

SEQ ID NO: 3705 - protein, 111 aa, Artificial Sequence
  Description of Artificial Sequence: Synthetic polypeptide
NFMLTQPHSVSESPGKTVTISCTGSSGSIASNYVHWYQQRPGSAPTTVIYEDNQRPSGVPDRFSGSIDSSSNSASLTISGLKTDDEADYYCQSFDSNTGRVFGGGTKLTVL

SEQ ID NO: 3706 - protein, 10 aa, Artificial Sequence
  Description of Artificial Sequence: Synthetic peptide
QSFDSNTGRV

SEQ ID NO: 3707 - protein, 127 aa, Artificial Sequence
  Description of Artificial Sequence: Synthetic polypeptide
QVQLVQSGAEVKKPGASVKVSCKASGYTFTSYYMHWVRQAPGQGLEWMGIINPTGGTTRYAQKFQGRVTMTRDTSTSTVYMELSSLRSEDTAVYYCARAPLYYDILTGYYPGAYDYWGQGTLVTVSS

SEQ ID NO: 3708 - protein, 20 aa, Artificial Sequence
  Description of Artificial Sequence: Synthetic peptide
ARAPLYYDILTGYYPGAYDY

SEQ ID NO: 3709 - protein, 110 aa, Artificial Sequence; identical to SEQ ID NO: 853
  Description of Artificial Sequence: Synthetic polypeptide

SEQ ID NO: 3710 - protein, 10 aa, Artificial Sequence
  Description of Artificial Sequence: Synthetic peptide
SSYTSSSTVV

SEQ ID NO: 3711 - protein, 116 aa, Artificial Sequence
  Description of Artificial Sequence: Synthetic polypeptide
QVQLVESGGGVVQPGRSLRVSCAASGFTFSTFAMHWVRQAPGKGLEWVAVISYDGGNRFYVDSVEGRFTISRDNSKNTLSLQMNSLRTEDTAVYYCARGGFGGLWFGQGTLVTVSS

SEQ ID NO: 3712 - protein, 8 aa, Artificial Sequence
  Description of Artificial Sequence: Synthetic peptide
QHRYNWLT

SEQ ID NO: 3713 - protein, 113 aa, Artificial Sequence
  Description of Artificial Sequence: Synthetic polypeptide
NFMLTQPHSMSESPGKTVTISCTGSGGSIALNYVEWYQQRPGSAPTTVIYEDNQRPSGVPDRFSGSIDSSSNSASLTISGLKTEDEADYYCQSYDGTTRGHVVFGGGTKLTVL

SEQ ID NO: 3714 - protein, 12 aa, Artificial Sequence
  Description of Artificial Sequence: Synthetic peptide
QSYDGTTRGHVV

SEQ ID NO: 3715 - protein, 120 aa, Artificial Sequence
  Description of Artificial Sequence: Synthetic polypeptide
EVQLVESGGGLVQPGGSLRLSCAASGFTFSSYRMHWVRQAPGKGPVWVSRINSDESNISYADSVKGRFTISRDNAKNTLYLQMNSLRAEDTAVYYCAREVHNEPGDYFDYWGQGTLVSVS

SEQ ID NO: 3716 - protein, 14 aa, Artificial Sequence
  Description of Artificial Sequence: Synthetic peptide
AREVHNEPGDYFDY

SEQ ID NO: 3717 - protein, 108 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSGDHWVFGGGTKLTVL

SEQ ID NO: 3718 - protein, 11 aa, Artificial Sequence
  Description of Artificial Sequence: Synthetic peptide
QVWDSSGDHWV

SEQ ID NO: 3719 - protein, 120 aa, Artificial Sequence
  Description of Artificial Sequence: Synthetic polypeptide
QVQLQESGPGLVKPSETLSLTCTVSGGSVFSGTYYWSWIRQPPGKGLEWIGYIYYSGSTNYNPSLKSRVTISIDPSKNQFSLNLSSVTAADTAVYYCARGSRSSYYFDYWGQGALVTVSS

SEQ ID NO: 3720 - protein, 12 aa, Artificial Sequence
  Description of Artificial Sequence: Synthetic peptide
ARGSRSSYYFDY

SEQ ID NO: 3721 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYEDNKRPSGIPDRFSGSKSGTSATLGIAGLQTGDEADYYCGTWDSSLSVPFVFGTGTKVTV

SEQ ID NO: 3722 - protein, 12 aa, Artificial Sequence
  Description of Artificial Sequence: Synthetic peptide
GTWDSSLSVPFV

SEQ ID NO: 3723 - protein, 124 aa, Artificial Sequence
  Description of Artificial Sequence: Synthetic polypeptide
QVQLQESGPGLVKPSQTLSLTCTVSGGSITSGDYYWTWIRQPPGKGLEWIGYIYYSGNTYYNLSLRSRITISEDTSKNQFSLKLRSVTAADTAVYYCARAMITFGGVIVVLDYWGQGTLVTVSS

SEQ ID NO: 3724 - protein, 16 aa, Artificial Sequence
  Description of Artificial Sequence: Synthetic peptide
ARAMITFGGVIVVLDY

SEQ ID NO: 3725 - protein, 111 aa, Artificial Sequence
  Description of Artificial Sequence: Synthetic polypeptide
QSVLTQPPSASGSPGQSVTISCTGTSTDVGGYNFVSWYQQHPGKAPKLMIYEVSKRPSGVPDRFSGSKSGNTASLTVSGLQAEDEADYYCSSYAGSNILYVFGTGTKVTVL

SEQ ID NO: 3726 - protein, 11 aa, Artificial Sequence
  Description of Artificial Sequence: Synthetic peptide
SSYAGSNILYV

SEQ ID NO: 3727 - protein, 130 aa, Artificial Sequence
  Description of Artificial Sequence: Synthetic polypeptide
QVQLVESGGGVVQPGRSLRLSCSASGFTFSSYAFHWVRQAPGKGLEWVAVVSHDGNNKFYADSVKGRLAIYRDNSKNTLYLQMISLQAEDTALYYCARDLGVVLPGPADDYFYFYGMDVWGLGTTVTVSS

SEQ ID NO: 3728 - protein, 23 aa, Artificial Sequence
  Description of Artificial Sequence: Synthetic peptide
ARDLGVVLPGPADDYFYFYGMDV

SEQ ID NO: 3729 - protein, 108 aa, Artificial Sequence
  Description of Artificial Sequence: Synthetic polypeptide
SYVLTQPPSVSVSPGQTARISCSGGALPKQYGYWYQQKPGQAPVLVIYKDSERPSGIPERFSGSSSGTAVTLTISGVQAEDEADYYCQSADRSGMSRVFGGGTKLTVL

SEQ ID NO: 3730 - protein, 11 aa, Artificial Sequence
  Description of Artificial Sequence: Synthetic peptide
QSADRSGMSRV

SEQ ID NO: 3731 - protein, 120 aa, Artificial Sequence; identical to SEQ ID NO: 263
  Description of Artificial Sequence: Synthetic polypeptide

SEQ ID NO: 3732 - protein, 13 aa, Artificial Sequence
  Description of Artificial Sequence: Synthetic peptide
ARDGGRPGDAFDL

SEQ ID NO: 3733 - protein, 109 aa, Artificial Sequence
  Description of Artificial Sequence: Synthetic polypeptide
QSVLTQPASVSGSPGQSITISCTGTSSDVGGYNYVSWYQQHPGKVPKVMIYDVSNRPSGISNRFSGSKSGNTASLTISGLQAEDEADYYCNSYRSNSTRVFGTGTKVTV

SEQ ID NO: 3734 - protein, 10 aa, Artificial Sequence
  Description of Artificial Sequence: Synthetic peptide
NSYRSNSTRV

SEQ ID NO: 3735 - protein, 120 aa, Artificial Sequence
  Description of Artificial Sequence: Synthetic polypeptide
QVQLQESGPGLVKPSQTLSLTCTVSGGSISRYYWSWLRQHPGKGLEWIGCIYDSGSTNYNPSLKSRLTISVDTSQNQLSLKLASVTAADAAVYYCARVPVGWEPPGFDLWGQGTTVTVSS

SEQ ID NO: 3736 - protein, 14 aa, Artificial Sequence
  Description of Artificial Sequence: Synthetic peptide
ARVPVGWEPPGFDL

SEQ ID NO: 3737 - protein, 107 aa, Artificial Sequence
  Description of Artificial Sequence: Synthetic polypeptide
SYVLTQPPSVSVAPGKTARVTCGGNNIGSKSVHWYQQKPGQAPVLVIYYDTDRPSGIPERFSGSNSGNTATLTISRVEAGDEADYYCQVWDSSSDHPVFGGGTKLTV

SEQ ID NO: 3738 - protein, 11 aa, Artificial Sequence
  Description of Artificial Sequence: Synthetic peptide
QVWDSSSDHPV

SEQ ID NO: 3739 - protein, 123 aa, Artificial Sequence
  Description of Artificial Sequence: Synthetic polypeptide
EVQLVQSGAEVKKPGESLKISCKGSGYTFTNYWIGWVRQMPGKGLEWMGIIYPGDSDTRYSPSFQGQVTISADKSISTAYLQWSSLKASDTAMYYCAIGALQMATIIDAFDIWGQGTMVTVSS

SEQ ID NO: 3740 - protein, 16 aa, Artificial Sequence
  Description of Artificial Sequence: Synthetic peptide
AIGALQMATIIDAFDI

SEQ ID NO: 3741 - protein, 110 aa, Artificial Sequence
  Description of Artificial Sequence: Synthetic polypeptide
QSVLTQPPSASGTPGQRVTISCSGSSSNIGGNAVNWYQQLPGTAPKLLIYTNNQRPSGVPDRFSGSKSGTSASLSISGLQSEDEADYYCAAWDDSLNGVVFGGGTKLTAL

SEQ ID NO: 3742 - protein, 11 aa, Artificial Sequence
  Description of Artificial Sequence: Synthetic peptide
AAWDDSLNGVV

SEQ ID NO: 3743 - protein, 117 aa, Artificial Sequence
  Description of Artificial Sequence: Synthetic polypeptide
EVQLVESGGGLIQPGGSLRLSCAASGLTVSRNYMTWVRQAPGKGLEWVSVIYSGGTTHYADSVKGRFTISRDNSKNTLYLQMNSLRAEDTAVYYCARDLAVYGMDVWGQGTTVTVSS

SEQ ID NO: 3744 - protein, 11 aa, Artificial Sequence
  Description of Artificial Sequence: Synthetic peptide
ARDLAVYGMDV

SEQ ID NO: 3745 - protein, 109 aa, Artificial Sequence
  Description of Artificial Sequence: Synthetic polypeptide
QSVLTQPPSVSGAPGQRVTISCTGSSSNIGAGSDVHWYQKLPGTAPKVLVYGYSNRPSGVPDRFSGSKSGTSASLAITGLQAEDEADYYCQSYDTSLRVLFGGGTKLTV

SEQ ID NO: 3746 - protein, 10 aa, Artificial Sequence
  Description of Artificial Sequence: Synthetic peptide
QSYDTSLRVL

SEQ ID NO: 3747 - protein, 122 aa, Artificial Sequence; identical to SEQ ID NO: 267
  Description of Artificial Sequence: Synthetic polypeptide

SEQ ID NO: 3748 - protein, 15 aa, Artificial Sequence
  Description of Artificial Sequence: Synthetic peptide
ARAMAVAGTSGDFDY

SEQ ID NO: 3749 - protein, 111 aa, Artificial Sequence; identical to SEQ ID NO: 266
  Description of Artificial Sequence: Synthetic polypeptide

SEQ ID NO: 3750 - protein, 12 aa, Artificial Sequence
  Description of Artificial Sequence: Synthetic peptide
AAWDDSLNGHVV

SEQ ID NO: 3751 - protein, 124 aa, Artificial Sequence; identical to SEQ ID NO: 291
  Description of Artificial Sequence: Synthetic polypeptide

SEQ ID NO: 3752 - protein, 17 aa, Artificial Sequence
  Description of Artificial Sequence: Synthetic peptide
ASRWEQLNGGSWHYFDY

SEQ ID NO: 3753 - protein, 112 aa, Artificial Sequence
  Description of Artificial Sequence: Synthetic polypeptide
QSVLTQPASVSGSPGQSITISCTGTRSDVGRNNLVSWYQHHPGKAPKVMIYEGSKRPSGVSTRFSGSKSGNTASLTISGLQAEDEADYYCCSYAGSSTFEGVFGGGTKLTVL

SEQ ID NO: 3754 - protein, 12 aa, Artificial Sequence
  Description of Artificial Sequence: Synthetic peptide
CSYAGSSTFEGV

SEQ ID NO: 3755 - protein, 123 aa, Artificial Sequence; identical to SEQ ID NO: 277
  Description of Artificial Sequence: Synthetic polypeptide

SEQ ID NO: 3756 - protein, 16 aa, Artificial Sequence
  Description of Artificial Sequence: Synthetic peptide
ARGGPPGGVKLELTDF

SEQ ID NO: 3757 - protein, 111 aa, Artificial Sequence; identical to SEQ ID NO: 278
  Description of Artificial Sequence: Synthetic polypeptide

SEQ ID NO: 3758 - protein, 12 aa, Artificial Sequence
  Description of Artificial Sequence: Synthetic peptide
AAWDDSLDGPVV

SEQ ID NO: 3759 - protein, 123 aa, Artificial Sequence
  Description of Artificial Sequence: Synthetic polypeptide
QVQLVQSGAEVKKPGASVKVSCKASGYTFTGFFIHWVRQAPGQGLEWMGWINPISGGTNYAQKFQGRVTVTRDTSITTVYVEVSSLRSDDTAVYYCARSNDIVAASTFYFHFWGQGTLVTVSS

SEQ ID NO: 3760 - protein, 16 aa, Artificial Sequence
  Description of Artificial Sequence: Synthetic peptide
ARSNDIVAASTFYFHF

SEQ ID NO: 3761 - protein, 107 aa, Artificial Sequence
  Description of Artificial Sequence: Synthetic polypeptide
SYVLTQPPSVSVAPGKTARITCGGKNFGSKSVHWYQQKPGQAPVLVIYYDTDRPSGIPERFSGSNSGNTATLTISGVEAGDEADYYCQVWYSSSDGVFGGGTKLTVL

SEQ ID NO: 3762 - protein, 10 aa, Artificial Sequence
  Description of Artificial Sequence: Synthetic peptide
QVWYSSSDGV

SEQ ID NO: 3763 - protein, 120 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARELTHDVTPYFDYWGQGTLVTVSS

SEQ ID NO: 3764 - protein, 14 aa, Artificial Sequence
  Description of Artificial Sequence: Synthetic peptide
ARELTHDVTPYFDY

SEQ ID NO: 3765 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWGVFGGGTKLTVL

SEQ ID NO: 3766 - protein, 12 aa, Artificial Sequence
  Description of Artificial Sequence: Synthetic peptide
QSYDSSLSGWGV

SEQ ID NO: 3767 - protein, 119 aa, Artificial Sequence
  Description of Artificial Sequence: Synthetic polypeptide
EVQLVQSGAEVKKPGESLRISCKGSGYSFSSYWITWVRQRPGKGLEWMGKIDPSDSYLNYSPSFQGHVTISADKSTRTAYLQWSSLKASDTAMYYCARHWGRFGEGDYWGQGTLVTVSS

SEQ ID NO: 3768 - protein, 12 aa, Artificial Sequence
  Description of Artificial Sequence: Synthetic peptide
ARHWGRFGEGDY

SEQ ID NO: 3769 - protein, 112 aa, Artificial Sequence
  Description of Artificial Sequence: Synthetic polypeptide
QSVLTQPPSVSGAPGQKVTISCTGSSSNIGAGYNLHWYQQLPGAAPKLLIDANGNRPSGVPDRFSGSKSGTSASLAITGLQAEDEADYYCQSYDSSLVPSWVFGGGTKLTVL

SEQ ID NO: 3770 - protein, 12 aa, Artificial Sequence
  Description of Artificial Sequence: Synthetic peptide
QSYDSSLVPSWV

SEQ ID NO: 3771 - protein, 120 aa, Artificial Sequence; identical to SEQ ID NO: 251
  Description of Artificial Sequence: Synthetic polypeptide

SEQ ID NO: 3772 - protein, 12 aa, Artificial Sequence
  Description of Artificial Sequence: Synthetic peptide
ATGSKSSYYFDY

SEQ ID NO: 3773 - protein, 111 aa, Artificial Sequence; identical to SEQ ID NO: 252
  Description of Artificial Sequence: Synthetic polypeptide

SEQ ID NO: 3774 - protein, 12 aa, Artificial Sequence
  Description of Artificial Sequence: Synthetic peptide
GTWDSSLSVPYV

SEQ ID NO: 3775 - protein, 117 aa, Artificial Sequence; identical to SEQ ID NO: 281
  Description of Artificial Sequence: Synthetic polypeptide

SEQ ID NO: 3776 - protein, 11 aa, Artificial Sequence
  Description of Artificial Sequence: Synthetic peptide
AKPVDAAMFDF

SEQ ID NO: 3777 - protein, 109 aa, Artificial Sequence
  Description of Artificial Sequence: Synthetic polypeptide
SYVLTQPPSVSVAPGKTARITCGGNNIGSKSVHWYQQRPGQAPVLVIYYDSDRPSGIPERFSGSNSGNTATLTISRVEAGDEADFYCQVWDRSTNHLVVFGGGTQLTVL

SEQ ID NO: 3778 - protein, 12 aa, Artificial Sequence
  Description of Artificial Sequence: Synthetic peptide
QVWDRSTNHLVV

SEQ ID NO: 3779 - protein, 118 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGSAWEIDYWGQGTLVTVSS

SEQ ID NO: 3780 - protein, 11 aa, Artificial Sequence
  Description of Artificial Sequence: Synthetic peptide
ARRGSAWEIDY

SEQ ID NO: 3781 - protein, 110 aa, Artificial Sequence
  Description of Artificial Sequence: Synthetic polypeptide
QSVLTQPPSASGTPGQRVTISCSGSTSNIGSNTVNWYQQLPGTAPKLLIYNNNQRPSGVPDRMSGSKSGTSASLAISGLQSEDEADYYCAAWDDSLNGYVFGTGTKVTVL

SEQ ID NO: 3782 - protein, 11 aa, Artificial Sequence
  Description of Artificial Sequence: Synthetic peptide
AAWDDSLNGYV

SEQ ID NO: 3783 - protein, 122 aa, Artificial Sequence
  Description of Artificial Sequence: Synthetic polypeptide
QVQLVQSGAEVKKPGASVKVSCRASGYTFPNYDLNWVRQATGQGLEWMGWMNPNSGNTGYAQKFQGRITMTRITSISTAYMELSSLRSEDTAVYYCARGRANWNSNFLLDSWGQGTLVTVSS

SEQ ID NO: 3784 - protein, 15 aa, Artificial Sequence
  Description of Artificial Sequence: Synthetic peptide
ARGRANWNSNFLLDS

SEQ ID NO: 3785 - protein, 111 aa, Artificial Sequence
  Description of Artificial Sequence: Synthetic polypeptide
QSVLTQPASVSGSPGQSITISCTGTSSDVGGYNLVSWYQQYPGNVPKLMIYEDAKRPSGVSNRFSGSKSANTASLTISGLQAEDEADYYCCSYAGSSTRYVFGTGTKVTVL

SEQ ID NO: 3786 - protein, 11 aa, Artificial Sequence
  Description of Artificial Sequence: Synthetic peptide
CSYAGSSTRYV

SEQ ID NO: 3787 - protein, 122 aa, Artificial Sequence
  Description of Artificial Sequence: Synthetic polypeptide
QVQLVQSGAEVKKPGASVKVSCKASGYIFTGYYMHWVRQAPGQGLEWIGWINPNSGGTNSTQKFQGRVTMTRDKSISTVYMELSRLRSDDTAVYYCARDLAFSMVRGVFDHWGQGTLVTVSS

SEQ ID NO: 3788 - protein, 15 aa, Artificial Sequence
  Description of Artificial Sequence: Synthetic peptide
ARDLAFSMVRGVFDH

SEQ ID NO: 3789 - protein, 110 aa, Artificial Sequence
  Description of Artificial Sequence: Synthetic polypeptide
QSVLTQPASVSGSPGQSITISCTGTSSDVGSYNLVSWYQQHPGKAPKLMIYEGSKWPSGVSNRFSGSKSGNTASLTISGLQAEDEADYYCCSYAGSNSWVFGGGTKLTVL

SEQ ID NO: 3790 - protein, 10 aa, Artificial Sequence
  Description of Artificial Sequence: Synthetic peptide
CSYAGSNSWV

SEQ ID NO: 3791 - protein, 125 aa, Artificial Sequence
  Description of Artificial Sequence: Synthetic polypeptide
QVQLVQSGAEVKKPGASVKVSCEASGYTLSTYDINWVRQATGQGLEWMGWMKPSSGHTGYAQKFQGRVTMTRNTSISTAYMELSGLRSEDTAVYYCVRNIGGYGFGGGYNWFDPWGQGTLVTVSS

SEQ ID NO: 3792 - protein, 18 aa, Artificial Sequence
  Description of Artificial Sequence: Synthetic peptide
VRNIGGYGFGGGYNWFDP

SEQ ID NO: 3793 - protein, 110 aa, Artificial Sequence
  Description of Artificial Sequence: Synthetic polypeptide
QSVLTQPPSVSAAPGQKVTISCSGSSSNIENNYVSWYQQLPGTAPQLLIYDNNKRPSGIPGRFSGSKSGTSATLGITGLQTGDEAEYYCGTWDRSLSAYVFGTGTKVTVL

SEQ ID NO: 3794 - protein, 11 aa, Artificial Sequence
  Description of Artificial Sequence: Synthetic peptide
GTWDRSLSAYV

SEQ ID NO: 3795 - protein, 122 aa, Artificial Sequence
  Description of Artificial Sequence: Synthetic polypeptide
QLQLQESGPGLVKPSETLSLTCTVSGGSISTSSYFWGWIRQPPEKGLEWIGSIYSSGSTYYNPSLKSRLTISVDTSKNQLSLKLSSVTAADTAVYYCARLHQPPEGDWFDPWGQGTLVTVSS

SEQ ID NO: 3796 - protein, 14 aa, Artificial Sequence
  Description of Artificial Sequence: Synthetic peptide
ARLHQPPEGDWFDP

SEQ ID NO: 3797 - protein, 110 aa, Artificial Sequence
  Description of Artificial Sequence: Synthetic polypeptide
SYVLTQPPSVSVAPGKTASITCGGNDIGSKSVHWYQQKPGQAPVLVIYYDSDRPSGIPERFSGSNSGNTATLTISRVEGGDEADYYCQVWDSTSDRPLYVFGTGTKVTVL

SEQ ID NO: 3798 - protein, 13 aa, Artificial Sequence
  Description of Artificial Sequence: Synthetic peptide
QVWDSTSDRPLYV

SEQ ID NO: 3799 - protein, 119 aa, Artificial Sequence
  Description of Artificial Sequence: Synthetic polypeptide
EVQLVQSGAEVKKPGESLKISCRGSGYSFTNYWIGWVRQMPGKGLEWMGIIYPGDSDTRYNPSFQGQVTISADKSISTAYLQWSSLKASDTAMYYCATRGSGNLIFDYWGQGTLVTVSS

SEQ ID NO: 3800 - protein, 12 aa, Artificial Sequence
  Description of Artificial Sequence: Synthetic peptide
ATRGSGNLIFDY

SEQ ID NO: 3801 - protein, 111 aa, Artificial Sequence
  Description of Artificial Sequence: Synthetic polypeptide
QSVLTQPASVSGSPGQSITISCTGTSSDVGSYNLVSWYQQYPGKAPKLMIYEGSKRPSGISNRFSGSNSGNTASLTISGLQPEDEADYYCCSYAGSTTLWVFGGGTKLTVL

SEQ ID NO: 3802 - protein, 11 aa, Artificial Sequence
  Description of Artificial Sequence: Synthetic peptide
CSYAGSTTLWV

SEQ ID NO: 3803 - protein, 127 aa, Artificial Sequence
  Description of Artificial Sequence: Synthetic polypeptide
QVQLQESGPGLVKPSETLSLTCTVSGGSVSGGSFYWSWIRRPPGKGLEWIGYIHYSGSANHNPSLKSRVSMSVDTSKNQFSLKLSSVTAADTAVYFCARGLYYYDSGGYLGGDFDSWGQGTLVTVSS

SEQ ID NO: 3804 - protein, 19 aa, Artificial Sequence
  Description of Artificial Sequence: Synthetic peptide
ARGLYYYDSGGYLGGDFDS

SEQ ID NO: 3805 - protein, 116 aa, Artificial Sequence
  Description of Artificial Sequence: Synthetic polypeptide
QSVLTQSPSASASLGASVTLTCTLSSGYSNYNVDWYQQRPGTGPRFVMRVGTGGIVGSKGYGIPDRFSVLGSGLNRYLTIKNIQEEDESDYHCGADHGSGSNFVVVFGGGTRLTVL

SEQ ID NO: 3806 - protein, 13 aa, Artificial Sequence
  Description of Artificial Sequence: Synthetic peptide
GADHGSGSNFVVV

SEQ ID NO: 3807 - protein, 126 aa, Artificial Sequence
  Description of Artificial Sequence: Synthetic polypeptide
EVQLVESGGGLVQPGRSLRLSCVASGFTFEDYAMHWVRQVPGKGLEWVSGMSWNSGTIGYADSVKGRFIISRDNAQNSLYLQMRNLRTEDTALYYCAKIPSASYDFGSGHDVFDIWGQGTMVTVSS

SEQ ID NO: 3808 - protein, 19 aa, Artificial Sequence
  Description of Artificial Sequence: Synthetic peptide
AKIPSASYDFGSGHDVFDI

SEQ ID NO: 3809 - protein, 110 aa, Artificial Sequence
  Description of Artificial Sequence: Synthetic polypeptide
QSVLTQPPSSSGTPGQRVTISCSGSSSNIGSSYVYWFQQLPGTAPKLLIYRNNQRPSGVPDRFSGSKSGTSASLAISGLRSEDEADYYCAAWYDSLSGVVFGGGTKLTVL

SEQ ID NO: 3810 - protein, 11 aa, Artificial Sequence
  Description of Artificial Sequence: Synthetic peptide
AAWYDSLSGVV

SEQ ID NO: 3811 - protein, 124 aa, Artificial Sequence; identical to SEQ ID NO: 275
  Description of Artificial Sequence: Synthetic polypeptide

SEQ ID NO: 3812 - protein, 17 aa, Artificial Sequence
  Description of Artificial Sequence: Synthetic peptide
AKDPLPFRDYYYYYMDV

SEQ ID NO: 3813 - protein, 111 aa, Artificial Sequence
  Description of Artificial Sequence: Synthetic polypeptide
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLGVFGTGTKVTVL

SEQ ID NO: 3814 - protein, 11 aa, Artificial Sequence
  Description of Artificial Sequence: Synthetic peptide
SSYTSSSTLGV

SEQ ID NO: 3815 - protein, 128 aa, Artificial Sequence
  Description of Artificial Sequence: Synthetic polypeptide
QVQLQESGPGLVKPSQTLSLTCTVSGGSINNGSYYWTWIRQHPGKGLEWIGYIYYTGDTYYNPPLMSRLTVSVDTSKNQLSLKLSSVTAADTAVYYCASLIRAHTFGGVIVNPYFDYWGQGILVTVSS

SEQ ID NO: 3816 - protein, 20 aa, Artificial Sequence
  Description of Artificial Sequence: Synthetic peptide
ASLIRAHTFGGVIVNPYFDY

SEQ ID NO: 3817 - protein, 110 aa, Artificial Sequence
  Description of Artificial Sequence: Synthetic polypeptide
QSVLTQPPAASGTPGQRVTISCSGSSSNIGRNYVYWYQQLPGMAPKLLIYRNNQRPSGVPDRFSGSKSGPSASLAISGLRSEDEAAYYCAAWDDSLSGVLFGGGTNLAVL

SEQ ID NO: 3818 - protein, 11 aa, Artificial Sequence
  Description of Artificial Sequence: Synthetic peptide
AAWDDSLSGVL

SEQ ID NO: 3819 - protein, 121 aa, Artificial Sequence
  Description of Artificial Sequence: Synthetic polypeptide
QVQLVESGGGVVQPGRSLRLSCAASGFSFSRYPMSWVRQAPGKGLEWVAVISNDGSNKDYADSVKGRFTVSRDNSKNTVYLQMNSLRPEDTAVFYCAREAPGVVPKLFDSWGQGTLVTVSS

SEQ ID NO: 3820 - protein, 14 aa, Artificial Sequence
  Description of Artificial Sequence: Synthetic peptide
AREAPGVVPKLFDS

SEQ ID NO: 3821 - protein, 108 aa, Artificial Sequence
  Description of Artificial Sequence: Synthetic polypeptide
SYVLTQPPSVSVAPGRTARITCGGNNIGSKSVHWYQQKPGQAPVLVIYYDSDRPSGIPERFSGSNSGNTATLTISRVEAGDEADYSCQVWDSSADHPVFGGGTKLTVL

SEQ ID NO: 3822 - protein, 11 aa, Artificial Sequence
  Description of Artificial Sequence: Synthetic peptide
QVWDSSADHPV

SEQ ID NO: 3823 - protein, 125 aa, Artificial Sequence
  Description of Artificial Sequence: Synthetic polypeptide
QVQLVESGGGVVQPGRSLRLSCAASGFSFSTYGMHWVRQAPGKGLEWVAVISFDGSQKYYGDSVKGRFTISRDNPKNTLDLQMNSLRAEDTAVYYCAKVVVRGVIISLYYGMDVWGQGTTVTVSS

SEQ ID NO: 3824 - protein, 18 aa, Artificial Sequence
  Description of Artificial Sequence: Synthetic peptide
AKVVVRGVIISLYYGMDV

SEQ ID NO: 3825 - protein, 106 aa, Artificial Sequence
  Description of Artificial Sequence: Synthetic polypeptide
SYVLTQPPSVSVSPGQTASITCSGDKLGDKSACWYQQKPGQSPVLVIYQDNKRPSGIPERFSGSNSGNTATLTISGTQAMDEADYYCQAWDSSTAVFGGGTKLTVL

SEQ ID NO: 3826 - protein, 9 aa, Artificial Sequence
  Description of Artificial Sequence: Synthetic peptide
QAWDSSTAV

SEQ ID NO: 3827 - protein, 120 aa, Artificial Sequence
  Description of Artificial Sequence: Synthetic polypeptide
EVQLVQSGAEVKKPGESLKISCQGSGYSFISYWIGWVRHMPGKGLEWMGVIHPGDSDTRYSPSFQGQVTISADKSITTAYLQWSSLKASDTATYYCARLSSVTMGWFDPWGQGTLVSVTT

SEQ ID NO: 3828 - protein, 13 aa, Artificial Sequence
  Description of Artificial Sequence: Synthetic peptide
ARLSSVTMGWFDP

SEQ ID NO: 3829 - protein, 110 aa, Artificial Sequence
  Description of Artificial Sequence: Synthetic polypeptide
QSVLTQPPSASGPPGQRVTISCSGSSSNIGSNSVSWYHHLPGTAPKLLIFNNNQRPSGVPDRVSGSKSGTSASLAISGLQSEDEADYYCAAWDDSLDGVVFGGGTKLTVL

SEQ ID NO: 3830 - protein, 11 aa, Artificial Sequence
  Description of Artificial Sequence: Synthetic peptide
AAWDDSLDGVV

SEQ ID NO: 3831 - protein, 121 aa, Artificial Sequence
  Description of Artificial Sequence: Synthetic polypeptide
EVQLLESGGGLVQPGGSLRLSCAASGFTFPIFAMSWVRQAPGKGLKWVSGISGSEGTTYSADSVKGRFTISRDNSKNTLYLQMNSLRAEDTATYYCAKHPDGYISGWYLFWGQGTLVTVSS

SEQ ID NO: 3832 - protein, 14 aa, Artificial Sequence
  Description of Artificial Sequence: Synthetic peptide
AKHPDGYISGWYLF

SEQ ID NO: 3833 - protein, 107 aa, Artificial Sequence
  Description of Artificial Sequence: Synthetic polypeptide
SYVLTQPPSVSVVPGQTARITCGGNNIGGKSVNWYQQKPGQAPVLVIYYDGDRPSGIPERFSGSNSGNTATLTISRVEAGDEADYYCQVWDASSDPMVFGGGTKVTV

SEQ ID NO: 3834 - protein, 11 aa, Artificial Sequence
  Description of Artificial Sequence: Synthetic peptide
QVWDASSDPMV

SEQ ID NO: 3835 - protein, 126 aa, Artificial Sequence
  Description of Artificial Sequence: Synthetic polypeptide
  MOD_RES (31)..(31): Any amino acid
  MOD_RES (37)..(37): Any amino acid
  MOD_RES (39)..(39): Any amino acid
  MOD_RES (62)..(62): Any amino acid
  MOD_RES (66)..(66): Any amino acid
  MOD_RES (70)..(70): Any amino acid
EVQLVESGGGLVKPGGSLRLSCAASGFTFSXYSMNWXRXVPGKGVEWVSSSSSSNSYIYEAXSLKXGFTXSRDNAKNSLYLQMNSLRAEDTAVYYCARDPAGYSYGQYYYYYMDVWGKGTTVTVSS

SEQ ID NO: 3836 - protein, 19 aa, Artificial Sequence
  Description of Artificial Sequence: Synthetic peptide
ARDPAGYSYGQYYYYYMDV

SEQ ID NO: 3837 - protein, 111 aa, Artificial Sequence
  Description of Artificial Sequence: Synthetic polypeptide
QSVLTQPASVSGSPGQSITISCTGTSSDVGAYNYVSWYQHHPGKAPKLMIFDVTNRPSGVSNRFSGSKSGNTASLTISGLQAEDEADYYCSSYTRSSPLYVFGTGTKVTVL

SEQ ID NO: 3838 - protein, 11 aa, Artificial Sequence
  Description of Artificial Sequence: Synthetic peptide
SSYTRSSPLYV

SEQ ID NO: 3839 - protein, 124 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGTIGYADSVKGRFTISRDNAKNSLSLQMNSLRYEDTALYYCAKDLGYDFRTSYNYYDYWGQGTLVTVSS

SEQ ID NO: 3840 - protein, 17 aa, Artificial Sequence
  Description of Artificial Sequence: Synthetic peptide
AKDLGYDFRTSYNYYDY

SEQ ID NO: 3841 - protein, 110 aa, Artificial Sequence
  Description of Artificial Sequence: Synthetic polypeptide
QSVLTQPPSVSGAPGQRVTISCTGSSSNIGAGYDVHWYQQLPGTAPKLLIYANNNRPSGVPDRFSGSKSGTSASLAITGLQAEDEADYYCQSYDSSLSQVFGTGTKVTVL

SEQ ID NO: 3842 - protein, 10 aa, Artificial Sequence
  Description of Artificial Sequence: Synthetic peptide
QSYDSSLSQV

SEQ ID NO: 3843 - protein, 123 aa, Artificial Sequence
  Description of Artificial Sequence: Synthetic polypeptide
QVQLVQSGAEIKKPGASVKVACKASGFTFSGYYIHWVRQAPGQGLEWMGWIIPDSGGANYAQKFQGRVTMTRDTSITTAYMELSSLRSDDTAMYYCARDDSTGYPNPNDAFDIWGQGTLVTVS

SEQ ID NO: 3844 - protein, 17 aa, Artificial Sequence
  Description of Artificial Sequence: Synthetic peptide
ARDDSTGYPNPNDAFDI

SEQ ID NO: 3845 - protein, 111 aa, Artificial Sequence
  Description of Artificial Sequence: Synthetic polypeptide
QSVLTQPPSVSAAPGQKVTVSCSGSNSNIGNNFVSWYQQLPGTAPKLLIYENNKRPSGIPDRFSGSKSGTSATLVITGLQTGDEADYYCGTWDSSLSVGWVFGGGTRLTVL

SEQ ID NO: 3846 - protein, 12 aa, Artificial Sequence
  Description of Artificial Sequence: Synthetic peptide
GTWDSSLSVGWV

SEQ ID NO: 3847 - protein, 121 aa, Artificial Sequence; identical to SEQ ID NO: 249
  Description of Artificial Sequence: Synthetic polypeptide

SEQ ID NO: 3848 - protein, 14 aa, Artificial Sequence
  Description of Artificial Sequence: Synthetic peptide
ARAIVVVTLNWFDL

SEQ ID NO: 3849 - protein, 110 aa, Artificial Sequence; identical to SEQ ID NO: 250
  Description of Artificial Sequence: Synthetic polypeptide

SEQ ID NO: 3850 - protein, 10 aa, Artificial Sequence
  Description of Artificial Sequence: Synthetic peptide
QSYDTSNPVI

SEQ ID NO: 3851 - protein, 125 aa, Artificial Sequence
  Description of Artificial Sequence: Synthetic polypeptide
QVQLVQSGAEVKKPGASVKVSCKASGYTFTDYYIHWVRQAPGQGLEWMGWINPNSGGTNYAQKFQGRVTMTRDTSISTAYMELSRLRSDDTAVYYCARDVIVSMVRGVIFRMDVWGQGTTVTVSS

SEQ ID NO: 3852 - protein, 18 aa, Artificial Sequence
  Description of Artificial Sequence: Synthetic peptide
ARDVIVSMVRGVIFRMDV

SEQ ID NO: 3853 - protein, 110 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSVSKSGTSASLAISGLQSEDEADYYCAAWDDSLNGVVFGGGTKLTVL

SEQ ID NO: 3854 - protein, 11 aa, Artificial Sequence
  Description of Artificial Sequence: Synthetic peptide
AAWDDSLNGVV

SEQ ID NO: 3855 - protein, 121 aa, Artificial Sequence
  Description of Artificial Sequence: Synthetic polypeptide
QVQLVESGGGVVQPGRSLRLSCAASGFTFSSHAMHWVRQAPGKGLEWVAVISYDGSNKYYADSVKGRFTISRDNSKNTLYLQMNSLRAEDTAVYYCAREDYYDSSGSFDYWGQGTLVTVSS

SEQ ID NO: 3856 - protein, 14 aa, Artificial Sequence
  Description of Artificial Sequence: Synthetic peptide
AREDYYDSSGSFDY

SEQ ID NO: 3857 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 3858 - protein, 10 aa, Artificial Sequence
  Description of Artificial Sequence: Synthetic peptide
SSYTSSSTWV

SEQ ID NO: 3859 - protein, 123 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAGGTNPQWLDSTFDYWGQGTLVTVSS

SEQ ID NO: 3860 - protein, 15 aa, Artificial Sequence
  Description of Artificial Sequence: Synthetic peptide
AGGTNPQWLDSTFDY

SEQ ID NO: 3861 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTYVFGTGTKVTVL

SEQ ID NO: 3862 - protein, 10 aa, Artificial Sequence
  Description of Artificial Sequence: Synthetic peptide
SSYTSSSTYV

SEQ ID NO: 3863 - protein, 120 aa, Artificial Sequence
  Description of Artificial Sequence: Synthetic polypeptide
EVQLVQSGAEVKKPGESLKISCKGSGYSFISYWIGWVRQMPGKGLEWMGIIYPGDSDTRYSPSFQGQVTISADKSISTAYLQWSSLKASDTAMYYCARRPSSYSGWFDPWGQGTLVTVSS

SEQ ID NO: 3864 - protein, 13 aa, Artificial Sequence
  Description of Artificial Sequence: Synthetic peptide
ARRPSSYSGWFDP

SEQ ID NO: 3865 - protein, 110 aa, Artificial Sequence
  Description of Artificial Sequence: Synthetic polypeptide
QSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLNGLVFGGGTKLTVL

SEQ ID NO: 3866 - protein, 11 aa, Artificial Sequence
  Description of Artificial Sequence: Synthetic peptide
AAWDDSLNGLV

SEQ ID NO: 3867 - protein, 125 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCATAHPRRIQGVFFLGPGVWGQGTTVTVSS

SEQ ID NO: 3868 - protein, 18 aa, Artificial Sequence
  Description of Artificial Sequence: Synthetic peptide
ATAHPRRIQGVFFLGPGV

SEQ ID NO: 3869 - protein, 110 aa, Artificial Sequence; identical to SEQ ID NO: 3121
  Description of Artificial Sequence: Synthetic polypeptide

SEQ ID NO: 3870 - protein, 11 aa, Artificial Sequence
  Description of Artificial Sequence: Synthetic peptide
AAWDDSLNGVV

SEQ ID NO: 3871 - protein, 123 aa, Artificial Sequence
  Description of Artificial Sequence: Synthetic polypeptide
QVQLVQSGAEVKKPGSSVKVSCKASGGTFRSYAISWVRQAPGQGLEWMGGIIPIFGTTNYAQKFQGRVTITADESTSRAYMELSSLRSEDTAVYYCARDSSGYYYVSNWFDPWGQGTLVTVSS

SEQ ID NO: 3872 - protein, 16 aa, Artificial Sequence
  Description of Artificial Sequence: Synthetic peptide
ARDSSGYYYVSNWFDP

SEQ ID NO: 3873 - protein, 111 aa, Artificial Sequence
  Description of Artificial Sequence: Synthetic polypeptide
QSVLTQPPSVSGAPGQRVTISCTGSSSNIGAGYDVHWYQQLPGTAPNLLIYDNINRPSGVPDRFSGSKSGTSASLAITGLQAEDEADYYCQSYDSSLSGVVFGGGTKLTVL

SEQ ID NO: 3874 - protein, 11 aa, Artificial Sequence
  Description of Artificial Sequence: Synthetic peptide
QSYDSSLSGVV

SEQ ID NO: 3875 - protein, 118 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMHSLRAEDTAVYYCARGEGWDLPYDYWGQGTLVTVSS

SEQ ID NO: 3876 - protein, 12 aa, Artificial Sequence
  Description of Artificial Sequence: Synthetic peptide
ARGEGWDLPYDY

SEQ ID NO: 3877 - protein, 111 aa, Artificial Sequence
  Description of Artificial Sequence: Synthetic polypeptide
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNFVVFGGGTKLTVL

SEQ ID NO: 3878 - protein, 11 aa, Artificial Sequence
  Description of Artificial Sequence: Synthetic peptide
SSYAGSNNFVV

SEQ ID NO: 3879 - protein, 119 aa, Artificial Sequence
  Description of Artificial Sequence: Synthetic polypeptide
EVQLVESGGGLVQPGGSLRLSCADSGFTFSSYWMSWVRQAPGKGLEWVANIKQDGSEKYYVDSVKGRFTISRDNAKNSLYLQMNSLRAEDTAVYYCAVQLWLRGNFDYWGQGTLVTVSS

SEQ ID NO: 3880 - protein, 12 aa, Artificial Sequence
  Description of Artificial Sequence: Synthetic peptide
AVQLWLRGNFDY

SEQ ID NO: 3881 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLAISGLKTEDEADYYCQSYDSSNHVVFGGGTKLTVL

SEQ ID NO: 3882 - protein, 10 aa, Artificial Sequence
  Description of Artificial Sequence: Synthetic peptide
QSYDSSNHVV

SEQ ID NO: 3883 - protein, 118 aa, Artificial Sequence
  Description of Artificial Sequence: Synthetic polypeptide
EVQLVESGGGLIQPGGSLRLSCAASGFTVSSNYMSWVRQAPGKGLEWVSVIYTGGSTFYADSVKGRFTISRDNSKNTLYLQMNSLRAEDTAMYYCARGEGWDLPYDYWGQGTLVTVSS

SEQ ID NO: 3884 - protein, 12 aa, Artificial Sequence
  Description of Artificial Sequence: Synthetic peptide
ARGEGWDLPYDY

SEQ ID NO: 3885 - protein, 111 aa, Artificial Sequence
  Description of Artificial Sequence: Synthetic polypeptide
QSVLTQPPSASGSPGQSVTISCTGTSSDVGGYNYVSWYQQHPGKAPKLMIYEVRKRPSGVPDRFSGSKSGNTASLTVSGLQAEDEADYYCSSYAGSNNFVLFGGGTKLTVL

SEQ ID NO: 3886 - protein, 11 aa, Artificial Sequence
  Description of Artificial Sequence: Synthetic peptide
SSYAGSNNFVL

SEQ ID NO: 3887 - protein, 121 aa, Artificial Sequence
  Description of Artificial Sequence: Synthetic polypeptide
EVQLVESGGGLVQPGGSLRLSCAASGFTFSSYYMNWVRQAPGKGLEWVSYISSSSSTIYYADSVKGRFTISRDNAKNSLYLQMNSLRDEDTAVYYCARDPQRDPADYFDYWGQGTLVTVSS

SEQ ID NO: 3888 - protein, 14 aa, Artificial Sequence
  Description of Artificial Sequence: Synthetic peptide
ARDPQRDPADYFDY

SEQ ID NO: 3889 - protein, 105 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSRVFGGGTKLTVL

SEQ ID NO: 3890 - protein, 8 aa, Artificial Sequence
  Description of Artificial Sequence: Synthetic peptide
QVWDSSRV

SEQ ID NO: 3891 - protein, 120 aa, Artificial Sequence
  Description of Artificial Sequence: Synthetic polypeptide
QVQLQESGPGLVKPSGTLSLTCAVSGGSISSTNWWSWVRQPPGKGLEWIGEIYHTGSTNYNPSLKSRVTISVDKSKNQFSLKLSSVTAADTAVYYCVRDGGRPGDAFDIWGQGTMVTVSS

SEQ ID NO: 3892 - protein, 13 aa, Artificial Sequence
  Description of Artificial Sequence: Synthetic peptide
VRDGGRPGDAFDI

SEQ ID NO: 3893 - protein, 110 aa, Artificial Sequence
  Description of Artificial Sequence: Synthetic polypeptide
QSALTQPASVSGSPGQSITISCTGTSSDVGGYNFVSWYQQHPGKAPKLMIYDVSNRPSGVSNRFSGSKSGNTASLTISGLQAEDEADYYCNSYTSSSTRVFGTGTKVTVL

SEQ ID NO: 3894 - protein, 10 aa, Artificial Sequence
  Description of Artificial Sequence: Synthetic peptide
NSYTSSSTRV

SEQ ID NO: 3895 - protein, 127 aa, Artificial Sequence
  Description of Artificial Sequence: Synthetic polypeptide
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCATRGGYYDSSGYYALAFDIWGQGTMVTVSS

SEQ ID NO: 3896 - protein, 19 aa, Artificial Sequence
  Description of Artificial Sequence: Synthetic peptide
ATRGGYYDSSGYYALAFDI

SEQ ID NO: 3897 - protein, 111 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTVWVFGGGTKLTVL

SEQ ID NO: 3898 - protein, 11 aa, Artificial Sequence
  Description of Artificial Sequence: Synthetic peptide
SSYTSSSTVWV

SEQ ID NO: 3899 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSGISDSGGSTYYADSVKGRFTISRDNSKNTLYLQMNSLRAEDTAVYYCAKEEVLPAVEYFQHWGQGTLVTVSS

SEQ ID NO: 3900 - protein, 14 aa, Artificial Sequence
  Description of Artificial Sequence: Synthetic peptide
AKEEVLPAVEYFQH

SEQ ID NO: 3901 - protein, 109 aa, Artificial Sequence
  Description of Artificial Sequence: Synthetic polypeptide
SYVLTQPPSVSVAPGKTARITCGGNNIGSKSVHWYQQKPGQAPVLVISYDSDRPSGIPERFSGSNSGNTATLTISRVEAGDAADYYCQVWDGSSDHHVVFGGGTKLTVL

SEQ ID NO: 3902 - protein, 12 aa, Artificial Sequence
  Description of Artificial Sequence: Synthetic peptide
QVWDGSSDHHVV

SEQ ID NO: 3903 - protein, 122 aa, Artificial Sequence; identical to SEQ ID NO: 265
  Description of Artificial Sequence: Synthetic polypeptide

SEQ ID NO: 3904 - protein, 15 aa, Artificial Sequence
  Description of Artificial Sequence: Synthetic peptide
ARAIAVAGTSGEFDY

SEQ ID NO: 3905 - protein, 111 aa, Artificial Sequence; identical to SEQ ID NO: 266
  Description of Artificial Sequence: Synthetic polypeptide

SEQ ID NO: 3906 - protein, 12 aa, Artificial Sequence
  Description of Artificial Sequence: Synthetic peptide
AAWDDSLNGHVV

SEQ ID NO: 3907 - protein, 119 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSQGWLQLNDYWGQGTLVTVSS

SEQ ID NO: 3908 - protein, 12 aa, Artificial Sequence
  Description of Artificial Sequence: Synthetic peptide
ARSQGWLQLNDY

SEQ ID NO: 3909 - protein, 112 aa, Artificial Sequence
  Description of Artificial Sequence: Synthetic polypeptide
NFMLTQPHSVSESPGKTVTISCTGSSGSIASNYVQWYQQRPGSAPTTMIYEDNQRPSGVPDRFSGSIDSSSNSASLTISGLKTEDEADYYCQSYDSSTPNCVFGGGTKLTVL

SEQ ID NO: 3910 - protein, 11 aa, Artificial Sequence
  Description of Artificial Sequence: Synthetic peptide
QSYDSSTPNCV

SEQ ID NO: 3911 - protein, 120 aa, Artificial Sequence
  Description of Artificial Sequence: Synthetic polypeptide
QVQLVQSGAEVKKPGASVKVSCKASGYTFTGYSMHWVRQAPGQGLEWMGWINPNSGGTNYAQKFQGRVTMTRDTSISTAYMELNRLRSDDTAVYYCARELIAVAGIFDYWGQGTLVTVSS

SEQ ID NO: 3912 - protein, 13 aa, Artificial Sequence
  Description of Artificial Sequence: Synthetic peptide
ARELIAVAGIFDY

SEQ ID NO: 3913 - protein, 105 aa, Artificial Sequence
  Description of Artificial Sequence: Synthetic polypeptide
SYVLTQPPSVSVAPGKTARITCGGNNIGSKNVHWYQQKPGQAPVLVIYYDSDRPSGIPERFSGSNSGNTATLTISRVEAGDEADYYCQVWDSSWVFGGGTKLTVL

SEQ ID NO: 3914 - protein, 8 aa, Artificial Sequence
  Description of Artificial Sequence: Synthetic peptide
QVWDSSWV

SEQ ID NO: 3915 - protein, 122 aa, Artificial Sequence
  Description of Artificial Sequence: Synthetic polypeptide
QVQLVQSGAEVKKPGASVMLSCKASGYTFTGYYMHWVRQAPGQGLEWMGWINPNSGGTNYAQKFQGRVTMTRDTSITTTYMELSRLRSDDTAVYYCARDLAFSMVRAPGDYWGQGTLVTVSS

SEQ ID NO: 3916 - protein, 15 aa, Artificial Sequence
  Description of Artificial Sequence: Synthetic peptide
ARDLAFSMVRAPGDY

SEQ ID NO: 3917 - protein, 110 aa, Artificial Sequence; identical to SEQ ID NO: 1789
  Description of Artificial Sequence: Synthetic polypeptide

SEQ ID NO: 3918 - protein, 10 aa, Artificial Sequence
  Description of Artificial Sequence: Synthetic peptide
CSYAGSSTWV

SEQ ID NO: 3919 - protein, 117 aa, Artificial Sequence
  Description of Artificial Sequence: Synthetic polypeptide
EVQLVESGGGLIQPGGSLKLSCVVSGFTVSKNYISWVRQAPGKGLEWVSVIFAGGSTFYADSVKGRFAISRDNSNNTLFLQMNSLRVEDTAIYYCARGDGELFFDHWGQGTLVTVSS

SEQ ID NO: 3920 - protein, 11 aa, Artificial Sequence
  Description of Artificial Sequence: Synthetic peptide
ARGDGELFFDH

SEQ ID NO: 3921 - protein, 110 aa, Artificial Sequence
  Description of Artificial Sequence: Synthetic polypeptide
QSVLTQPPSVSGAPGQRVTISCTGTSSNIGAGYDVHWYQQLPGRAPKVLISGNNIRPSEVPDRFSGSRSGTSASLAITSLQPEDEAQYYCQSYDSSLYAVFGGGTKLTVL

SEQ ID NO: 3922 - protein, 10 aa, Artificial Sequence
  Description of Artificial Sequence: Synthetic peptide
QSYDSSLYAV

SEQ ID NO: 3923 - protein, 122 aa, Artificial Sequence
  Description of Artificial Sequence: Synthetic polypeptide
QVQLVQSGAEVKKPGASVRVSCKASGYTFTSYGFSWVRQAPGQGLEWMGWISAYNGNTNFAQKLQGRVTMTTDTSTSTAYMELRSLRSDDTAVYYCARGEAVAGTTGFFDYWGQGTLVTVSS

SEQ ID NO: 3924 - protein, 15 aa, Artificial Sequence
  Description of Artificial Sequence: Synthetic peptide
ARGEAVAGTTGFFDY

SEQ ID NO: 3925 - protein, 111 aa, Artificial Sequence
  Description of Artificial Sequence: Synthetic polypeptide
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGFVVFGGGTKLTVL

SEQ ID NO: 3926 - protein, 12 aa, Artificial Sequence
  Description of Artificial Sequence: Synthetic peptide
AAWDDSLSGFVV

SEQ ID NO: 3927 - protein, 123 aa, Artificial Sequence
  Description of Artificial Sequence: Synthetic polypeptide
QLQLQESGPGLVKPSETLSLTCTVSGGSISSSSHYWGWIRQPPGKGLEWIGTIYYSGSTYYNPSLKSRVTISVDTSKNQFSLRLSSVTAADTAVYYCASAPYLNWNDWIFDYWGQGTLVTVSS

SEQ ID NO: 3928 - protein, 15 aa, Artificial Sequence
  Description of Artificial Sequence: Synthetic peptide
ASAPYLNWNDWIFDY

SEQ ID NO: 3929 - protein, 110 aa, Artificial Sequence
  Description of Artificial Sequence: Synthetic polypeptide
QSVLTQPASVSGSPGQSITISCTGTSSDVGGYNYVSWYQQHPGEAPKLMIHDVSNRPSGVSNRFSGSKSGNTASLTISGLQAEDEADYYCSSYTSSSTLVFGGGTKLTVL

SEQ ID NO: 3930 - protein, 10 aa, Artificial Sequence
  Description of Artificial Sequence: Synthetic peptide
SSYTSSSTLV

SEQ ID NO: 3931 - protein, 122 aa, Artificial Sequence; identical to SEQ ID NO: 3923
  Description of Artificial Sequence: Synthetic polypeptide

SEQ ID NO: 3932 - protein, 15 aa, Artificial Sequence
  Description of Artificial Sequence: Synthetic peptide
ARGEAVAGTTGFFDY

SEQ ID NO: 3933 - protein, 111 aa, Artificial Sequence; identical to SEQ ID NO: 3925
  Description of Artificial Sequence: Synthetic polypeptide

SEQ ID NO: 3934 - protein, 12 aa, Artificial Sequence
  Description of Artificial Sequence: Synthetic peptide
AAWDDSLSGFVV

SEQ ID NO: 3935 - protein, 117 aa, Artificial Sequence
  Description of Artificial Sequence: Synthetic polypeptide
EVQLVESGGGLIQPGGSLKLSCVVSGFTVSKNYISWVRQAPGKGLEWVSVIFAGGSTFYADSVKGRFAISRDNSNNTLFLQMNSLRVEDTAIYYCARGDGELFFDQWGQGTLVTVSS

SEQ ID NO: 3936 - protein, 11 aa, Artificial Sequence
  Description of Artificial Sequence: Synthetic peptide
ARGDGELFFDQ

SEQ ID NO: 3937 - protein, 110 aa, Artificial Sequence; identical to SEQ ID NO: 3921
  Description of Artificial Sequence: Synthetic polypeptide

SEQ ID NO: 3938 - protein, 10 aa, Artificial Sequence
  Description of Artificial Sequence: Synthetic peptide
QSYDSSLYAV

SEQ ID NO: 3939 - protein, 132 aa, Artificial Sequence
  Description of Artificial Sequence: Synthetic polypeptide
QVQLQESGPGLVKPSETLSLTCTVSGASVSSGSYYWSWIRQPPGKGLEWIGYIYYSGSTNYNPSLKSRVTISVDTSKNQFSLKLSSVTAADTAVYYCARERPGGTYSNTWYTPTDTNWFDTWGQGTLVTVSS

SEQ ID NO: 3940 - protein, 24 aa, Artificial Sequence
  Description of Artificial Sequence: Synthetic peptide
ARERPGGTYSNTWYTPTDTNWFDT

SEQ ID NO: 3941 - protein, 108 aa, Artificial Sequence
  Description of Artificial Sequence: Synthetic polypeptide
SYVLTQPPSVSVAPGKTARITCGGNNIGSKSVHWYQQKPGQAPVLVIYFDSDRPSGIPERFSGSNSGNTATLTISRVEAGDEADYYCQVWDSSRDHVVFGGGTKLTVL

SEQ ID NO: 3942 - protein, 11 aa, Artificial Sequence
  Description of Artificial Sequence: Synthetic peptide
QVWDSSRDHVV

SEQ ID NO: 3943 - protein, 127 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKLQGRVTMTRDTSTSTVYMELSSLRSEDTAVYYCARANHETTMDTYYYYYYMDVWGKGTTVTVSS

SEQ ID NO: 3944 - protein, 20 aa, Artificial Sequence
  Description of Artificial Sequence: Synthetic peptide
ARANHETTMDTYYYYYYMDV

SEQ ID NO: 3945 - protein, 111 aa, Artificial Sequence
  Description of Artificial Sequence: Synthetic polypeptide
QSVLTQPASVSGSPGQSITISCTGTSSDVGGYKYVSWYQRHPGKAPKLMIYDVSNRPSGVSNRFSGSKSGNTASLTISGLQAEDEADYYCSSYTSSSTSVVFGGGTQLTVL

SEQ ID NO: 3946 - protein, 11 aa, Artificial Sequence
  Description of Artificial Sequence: Synthetic peptide
SSYTSSSTSVV

SEQ ID NO: 3947 - protein, 125 aa, Artificial Sequence; identical to SEQ ID NO: 299
  Description of Artificial Sequence: Synthetic polypeptide

SEQ ID NO: 3948 - protein, 18 aa, Artificial Sequence
  Description of Artificial Sequence: Synthetic peptide
ARYKGTTVNTNYYYGMDV

SEQ ID NO: 3949 - protein, 106 aa, Artificial Sequence
  Description of Artificial Sequence: Synthetic polypeptide
SYVLTQPPSVSVSPGQTASITCSGDKLGDKYACWYQQKAGQSPVLVIYQDSKRPSGIPERFSGSKSGNTATLTISGTQAMDEADYYCQAWDSSTVVFGGGTKLTVL

SEQ ID NO: 3950 - protein, 9 aa, Artificial Sequence
  Description of Artificial Sequence: Synthetic peptide
QAWDSSTVV

SEQ ID NO: 3951 - protein, 127 aa, Artificial Sequence; identical to SEQ ID NO: 3943
  Description of Artificial Sequence: Synthetic polypeptide

SEQ ID NO: 3952 - protein, 20 aa, Artificial Sequence
  Description of Artificial Sequence: Synthetic peptide
ARANHETTMDTYYYYYYMDV

SEQ ID NO: 3953 - protein, 111 aa, Artificial Sequence
  Description of Artificial Sequence: Synthetic polypeptide
QSALTQPASVSGSPGQSITISCTGTSSDVGGYKYVSWYQRHPGKAPKLMIYDVSNRPSGVSNRFSGSKSGNTASLTISGLQAEDEADYYCSSYTSSSTSVVFGGGTQLTVL

SEQ ID NO: 3954 - protein, 11 aa, Artificial Sequence
  Description of Artificial Sequence: Synthetic peptide
SSYTSSSTSVV

SEQ ID NO: 3955 - protein, 125 aa, Artificial Sequence
  Description of Artificial Sequence: Synthetic polypeptide
EVQLVQSGAEVKKPGESLKISCKGSGYSFTSYWIGWVRQMPGKGLEWMGILYPGDSDTTYSPSFQGQVTISADKSISTAYLQWSSLKASDTAMYYCARLHPTYYDILTGYYIDYWGQGTLVTVSS

SEQ ID NO: 3956 - protein, 18 aa, Artificial Sequence
  Description of Artificial Sequence: Synthetic peptide
ARLHPTYYDILTGYYIDY

SEQ ID NO: 3957 - protein, 109 aa, Artificial Sequence
  Description of Artificial Sequence: Synthetic polypeptide
QSALTQPASVSGSPGQSITISCTGTSSDVGSYNLVSWYQQHPGKAPKLMIYEGSKRPSGVSNRFSGSKSGNTASLTISGLQAEDEADYYCCLYAFSSIVFGGGTKLTVL

SEQ ID NO: 3958 - protein, 9 aa, Artificial Sequence
  Description of Artificial Sequence: Synthetic peptide
CLYAFSSIV

SEQ ID NO: 3959 - protein, 120 aa, Artificial Sequence
  Description of Artificial Sequence: Synthetic polypeptide
QVQLQESGPGLVKPSETLSLTCTVSGGSISNYYWSWIRQPPGKGLEWIGYIYYSGSTNYNPSLKSRVTISVDTSKNQFSLKLTSVTAADTAVYYCARILRGVAENWFDPWGQGTLVTVSS

SEQ ID NO: 3960 - protein, 14 aa, Artificial Sequence
  Description of Artificial Sequence: Synthetic peptide
ARILRGVAENWFDP

SEQ ID NO: 3961 - protein, 109 aa, Artificial Sequence
  Description of Artificial Sequence: Synthetic polypeptide
SYVLTQPPSVSVAPGKTARITCGGNNIGSKSVHWYQQKPGQAPVLVIYYDTDRPSGIPERFSGSNSGNTATLTISRVEAGDEADYYCQVWDNNSDHRGVFGGGTRLTVL

SEQ ID NO: 3962 - protein, 12 aa, Artificial Sequence
  Description of Artificial Sequence: Synthetic peptide
QVWDNNSDHRGV

SEQ ID NO: 3963 - protein, 123 aa, Artificial Sequence; identical to SEQ ID NO: 279
  Description of Artificial Sequence: Synthetic polypeptide

SEQ ID NO: 3964 - protein, 16 aa, Artificial Sequence
  Description of Artificial Sequence: Synthetic peptide
ARGGPPGGVKLELTDY

SEQ ID NO: 3965 - protein, 111 aa, Artificial Sequence; identical to SEQ ID NO: 280
  Description of Artificial Sequence: Synthetic polypeptide

SEQ ID NO: 3966 - protein, 12 aa, Artificial Sequence
  Description of Artificial Sequence: Synthetic peptide
AAWDDSLNGPVV

SEQ ID NO: 3967 - protein, 126 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAGMYYDILTGYSEGAFDIWGQGTMVTVSS

SEQ ID NO: 3968 - protein, 18 aa, Artificial Sequence
  Description of Artificial Sequence: Synthetic peptide
AGMYYDILTGYSEGAFDI

SEQ ID NO: 3969 - protein, 110 aa, Artificial Sequence
  Description of Artificial Sequence: Synthetic polypeptide
QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVL

SEQ ID NO: 3970 - protein, 10 aa, Artificial Sequence
  Description of Artificial Sequence: Synthetic peptide
CSYAGSSTWV

SEQ ID NO: 3971 - protein, 126 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLDLQMNSLRAEDTAVYYCAKGGYYYYNSDSYQAEIDYWGQGTLVTVSS

SEQ ID NO: 3972 - protein, 19 aa, Artificial Sequence
  Description of Artificial Sequence: Synthetic peptide
AKGGYYYYNSDSYQAEIDY

SEQ ID NO: 3973 - protein, 110 aa, Artificial Sequence
  Description of Artificial Sequence: Synthetic polypeptide
QSVLTQPPSVSAAPGQRVTISCSGSSSNIGNNYVSWYQQLPGTAPKLLIYENNKRPSGIPDRFSGSKSGTSATLGITGLQTGDEADYYCGTWDSSLSAFVFGTGTKVTVL

SEQ ID NO: 3974 - protein, 11 aa, Artificial Sequence
  Description of Artificial Sequence: Synthetic peptide
GTWDSSLSAFV

SEQ ID NO: 3975 - protein, 118 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDFYHNWFDPWGQGTLVTVSS

SEQ ID NO: 3976 - protein, 11 aa, Artificial Sequence
  Description of Artificial Sequence: Synthetic peptide
ARDFYHNWFDP

SEQ ID NO: 3977 - protein, 112 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQWVVFGGGTKLTVL

SEQ ID NO: 3978 - protein, 11 aa, Artificial Sequence
  Description of Artificial Sequence: Synthetic peptide
QSYDSSNQWVV

SEQ ID NO: 3979 - protein, 121 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRGYADSVKGRFTISRDNAKNSLYLLMNSLRAEDTAFYYCAKDDREGFGDYFDYWGQGTLVTVSS

SEQ ID NO: 3980 - protein, 14 aa, Artificial Sequence
  Description of Artificial Sequence: Synthetic peptide
AKDDREGFGDYFDY

SEQ ID NO: 3981 - protein, 108 aa, Artificial Sequence
  Description of Artificial Sequence: Synthetic polypeptide
SYVLTQPPSVSVAPGKTARITCGGNNIGSKSVHWYQQKPGQAPVLVIYYDSVRPSGIPERFSGSNSGNTATLTISRVEAGDEADYYCQVWDSSSDHYVFGTGTKVTVL

SEQ ID NO: 3982 - protein, 11 aa, Artificial Sequence
  Description of Artificial Sequence: Synthetic peptide
QVWDSSSDHYV

SEQ ID NO: 3983 - protein, 118 aa, Artificial Sequence
  Description of Artificial Sequence: Synthetic polypeptide
QVQLQESGPGLVKPSETLSLSCAVSGGSIGSYFWSWIRQPPGKGLEWIGYLHYSGSTNYNPSLKSRVTISVDTSKNQFSLKLSSVTAADTAVYYCARLQWLRGAFDIWGQGTMVTVSS

SEQ ID NO: 3984 - protein, 12 aa, Artificial Sequence
  Description of Artificial Sequence: Synthetic peptide
ARLQWLRGAFDI

SEQ ID NO: 3985 - protein, 110 aa, Artificial Sequence
  Description of Artificial Sequence: Synthetic polypeptide
NFMLTQPHSVSESPGKTVTISCTGSSGSIASNYVQWYQQRPGSAPTTVINEDNQRPSGVPDRFSGSIDSSSNSASLTISGLKTEDEADYYCQSYDSSNLVFGGGTKLTVL

SEQ ID NO: 3986 - protein, 9 aa, Artificial Sequence
  Description of Artificial Sequence: Synthetic peptide
QSYDSSNLV

SEQ ID NO: 3987 - protein, 118 aa, Artificial Sequence
  Description of Artificial Sequence: Synthetic polypeptide
QVQLQESGPRLVKPSENLSLTCTVSGGSISSYYWSWIRQPPGKGLEWIGYIYYTGSTKYNPSLKSRVTISVDTSKNQFSLKLSSVTAADTAVFYCARATTPFSGVDYWGQGTLVTVSS

SEQ ID NO: 3988 - protein, 12 aa, Artificial Sequence
  Description of Artificial Sequence: Synthetic peptide
ARATTPFSGVDY

SEQ ID NO: 3989 - protein, 110 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDTSNWVFGGGTKLTVL

SEQ ID NO: 3990 - protein, 9 aa, Artificial Sequence
  Description of Artificial Sequence: Synthetic peptide
QSYDTSNWV

SEQ ID NO: 3991 - protein, 124 aa, Artificial Sequence
  Description of Artificial Sequence: Synthetic polypeptide
QVQLVESGGGVVQPGRSLRLSCAASGLTFSSYGMHWVRQAPGKGLEWVAVIWYDGINKYYADSVKGRFTISRDNSKNTLYLQMNSLRAEDTAVYYCARDRGLRLGGPKYYFDYWGQGTLVTVSS

SEQ ID NO: 3992 - protein, 17 aa, Artificial Sequence
  Description of Artificial Sequence: Synthetic peptide
ARDRGLRLGGPKYYFDY

SEQ ID NO: 3993 - protein, 109 aa, Artificial Sequence
  Description of Artificial Sequence: Synthetic polypeptide
QSVLTQPASVSGSPGQSITISCPGTSSDVGGYNYVSWYQQHPGKAPKLMIYDVSTRPSGVSNRFSGSKSGNTASLTISGLQAEDEADYYCSSYTSSSVVFGGGTKLTVL

SEQ ID NO: 3994 - protein, 9 aa, Artificial Sequence
  Description of Artificial Sequence: Synthetic peptide
SSYTSSSVV

SEQ ID NO: 3995 - protein, 128 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARETQGGYYGSGSYYASPFDPWGQGTLVTVSS

SEQ ID NO: 3996 - protein, 21 aa, Artificial Sequence
  Description of Artificial Sequence: Synthetic peptide
ARETQGGYYGSGSYYASPFDP

SEQ ID NO: 3997 - protein, 109 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPVVFGGGTKLTVL

SEQ ID NO: 3998 - protein, 12 aa, Artificial Sequence
  Description of Artificial Sequence: Synthetic peptide
QVWDSSSDHPVV

SEQ ID NO: 3999 - protein, 127 aa, Artificial Sequence
  Description of Artificial Sequence: Synthetic polypeptide
QVQLQESGPGLVKPSETLSLTCTVSGGSISNYYWSWIRQPPGKGLEWIGYIYYSGSTNYNPSLKSRVTISVDTSKNQFSLKLSSVTAADTAVYYCARVEDWGYCSSTNCYSGAFDIWGQGTMVTVSS

SEQ ID NO: 4000 - protein, 21 aa, Artificial Sequence
  Description of Artificial Sequence: Synthetic peptide
ARVEDWGYCSSTNCYSGAFDI

SEQ ID NO: 4001 - protein, 111 aa, Artificial Sequence
  Description of Artificial Sequence: Synthetic polypeptide
QSVLTQPPSVSEAPRQRVTISCSGSSSNIGNNAVNWYQQLPGKAPKLLIYYDDLLPSGVSDRFSGSKSGTSASLAISGLQSEDEADYYFAAWDDSLNGAWVFGGGTKLTVL

SEQ ID NO: 4002 - protein, 12 aa, Artificial Sequence
  Description of Artificial Sequence: Synthetic peptide
AAWDDSLNGAWV

SEQ ID NO: 4003 - protein, 126 aa, Artificial Sequence
  Description of Artificial Sequence: Synthetic polypeptide
QVQLVQSGAEVKKPGASVKVSCKASGYSFTSYYMHWVRQAPGQGLEWMGIINPSGGSTSYAQKFQGRVTMTRDTSTSTVYMELSSLRSEDTAVYYCARDPSPIIARPGMGYWFDPWGQGTLVTVSS

SEQ ID NO: 4004 - protein, 19 aa, Artificial Sequence
  Description of Artificial Sequence: Synthetic peptide
ARDPSPIIARPGMGYWFDP

SEQ ID NO: 4005 - protein, 111 aa, Artificial Sequence
  Description of Artificial Sequence: Synthetic polypeptide
QSVLTQPPSVSGAPGQRVTISCTGSSSNIGAGYDVHWYQHLPGTAPKLLIYGNNNRPSGVPDRFSGSRSGTSASLAITGLQAEDEADYYCQSYDSSLSAVVFGGGTKLTVL

SEQ ID NO: 4006 - protein, 11 aa, Artificial Sequence
  Description of Artificial Sequence: Synthetic peptide
QSYDSSLSAVV

SEQ ID NO: 4007 - protein, 127 aa, Artificial Sequence
  Description of Artificial Sequence: Synthetic polypeptide
QVQLVESGGGLVQPGRSLRLSCAASGFTFSTYAMHWVRQAPGKGLKWVAVISYDGGNKYYADSVKGRFTISRDNSKNTLYLQMNSLRAEDTAVYYCARDPIWFGELLSPPFVHFDYWGQGTLVTVSS

SEQ ID NO: 4008 - protein, 20 aa, Artificial Sequence
  Description of Artificial Sequence: Synthetic peptide
ARDPIWFGELLSPPFVHFDY

SEQ ID NO: 4009 - protein, 113 aa, Artificial Sequence
  Description of Artificial Sequence: Synthetic polypeptide
QSVLTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGGVYVFGTGTTVTVL

SEQ ID NO: 4010 - protein, 14 aa, Artificial Sequence
  Description of Artificial Sequence: Synthetic peptide
GTWDSSLSAGGVYV

SEQ ID NO: 4011 - protein, 123 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTKYAQKFQGRVTMTRDTSISTAYMELSRLRSDDTAVYYCARGHDYVWGSYRYHNVWGQGTLVTVSS

SEQ ID NO: 4012 - protein, 16 aa, Artificial Sequence
  Description of Artificial Sequence: Synthetic peptide
ARGHDYVWGSYRYHNV

SEQ ID NO: 4013 - protein, 110 aa, Artificial Sequence
  Description of Artificial Sequence: Synthetic polypeptide
  MOD_RES (109)..(109): Any amino acid
QSVLTQPASVSGSPGQSITISCTGTSSDVGGYNYVSWYQQHPGKAPKVMIYDVSNRPSGVSNRFSGSKSGNTASLTISGLQAEDEADYYCSSYTSSSTLLFGGGTKLTXL

SEQ ID NO: 4014 - protein, 10 aa, Artificial Sequence
  Description of Artificial Sequence: Synthetic peptide
SSYTSSSTLL

SEQ ID NO: 4015 - protein, 119 aa, Artificial Sequence
  Description of Artificial Sequence: Synthetic polypeptide
EVQLVESGGGLVQPGGSLRLSCAASGFTFSSYWMSWVRQAPGKGLEWVANIKQDGSEKYYVDSVKGRFTISGDNAKNSLYLHMNSLRAEDTAVYYCAIQLWLRGGYDYWGQGTLVTVSS

SEQ ID NO: 4016 - protein, 12 aa, Artificial Sequence
  Description of Artificial Sequence: Synthetic peptide
AIQLWLRGGYDY

SEQ ID NO: 4017 - protein, 111 aa, Artificial Sequence
  Description of Artificial Sequence: Synthetic polypeptide
QSVLTQPPSASGSPGQSVTISCTGTSSDVGGYNYVSWYQQHPGKAPKLMIYEVTKRPSGVPDRFSGSKSGNTASLTVSGLQAEDEADYYCSSYAGSNNYVVFGGGTKLTVL

SEQ ID NO: 4018 - protein, 11 aa, Artificial Sequence
  Description of Artificial Sequence: Synthetic peptide
SSYAGSNNYVV

SEQ ID NO: 4019 - protein, 132 aa, Artificial Sequence
  Description of Artificial Sequence: Synthetic polypeptide
EVQLVESGGGLVKPGGSLRVSCAASGFTFSSYSMNWVRQAPGKGLEWVSSISSSKNYIYYADSVKGRFTISRDNAKNSLYLQMNSLRAEDTAVYYCTRGSRGYYDRSGYYTPLDPYYGMDVWGQGTTVTVSS

SEQ ID NO: 4020 - protein, 25 aa, Artificial Sequence
  Description of Artificial Sequence: Synthetic peptide
TRGSRGYYDRSGYYTPLDPYYGMDV

SEQ ID NO: 4021 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKVTVL

SEQ ID NO: 4022 - protein, 12 aa, Artificial Sequence
  Description of Artificial Sequence: Synthetic peptide
QSYDSSLSGSYV

SEQ ID NO: 4023 - protein, 127 aa, Artificial Sequence
  Description of Artificial Sequence: Synthetic polypeptide
  MOD_RES (58)..(58): Any amino acid
QVQLVESGGGVVQPGRSLRLSCAASGFTFSNYAMHWVRQAPGKGLEWVAVISYDGSNXYYADSVKGRFTISRDNSKNTLYLQMNSLRAEDTAIYYCASGYTGYDYFVRGDYYGLDVWGQGTTVTVSS

SEQ ID NO: 4024 - protein, 20 aa, Artificial Sequence
  Description of Artificial Sequence: Synthetic peptide
ASGYTGYDYFVRGDYYGLDV

SEQ ID NO: 4025 - protein, 111 aa, Artificial Sequence
  Description of Artificial Sequence: Synthetic polypeptide
QSVLTQSPSASASLGASVKLTCTLSSGHSSYAIAWHQQQPEKGPRYLMKLNTDGSHSKGDGIPDRFSGSSSGAERYLTISSLQSEDEADYYCQTWGTGILVFGGGTKLTVL

SEQ ID NO: 4026 - protein, 9 aa, Artificial Sequence
  Description of Artificial Sequence: Synthetic peptide
QTWGTGILV

SEQ ID NO: 4027 - protein, 118 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGEGWELPYDYWGQGTLVTVSS

SEQ ID NO: 4028 - protein, 12 aa, Artificial Sequence
  Description of Artificial Sequence: Synthetic peptide
ARGEGWELPYDY

SEQ ID NO: 4029 - protein, 111 aa, Artificial Sequence
  Description of Artificial Sequence: Synthetic polypeptide
QSVLTQPPSASGSPGQSVTISCTGTSSDVGGYKYVSWYQQHPGKAPKLMIYEVSKRPSGVPDRFSGSKSGNTASLTVSGLQAEDEADYYCSSYEGSNNFVVFGGGTKLTVL

SEQ ID NO: 4030 - protein, 11 aa, Artificial Sequence
  Description of Artificial Sequence: Synthetic peptide
SSYEGSNNFVV

SEQ ID NO: 4031 - protein, 124 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKSSLYLQMKSLRVEDTALYYCAKDSLVRRNFYYYYMDVWGKGTTVTVSS

SEQ ID NO: 4032 - protein, 17 aa, Artificial Sequence
  Description of Artificial Sequence: Synthetic peptide
AKDSLVRRNFYYYYMDV

SEQ ID NO: 4033 - protein, 111 aa, Artificial Sequence
  Description of Artificial Sequence: Synthetic polypeptide
  MOD_RES (110)..(110): Any amino acid
QSVLTQPPSVSGAPGQRVTISCTGSSSNIGAGYDVHWYQQLPGTAPKLLIYGNSDRPSGVPDRFSGSKSGTSASLAITGLQAEDEADYYCQSYDSSLSGVVFGGGTKLTXL

SEQ ID NO: 4034 - protein, 11 aa, Artificial Sequence
  Description of Artificial Sequence: Synthetic peptide
QSYDSSLSGVV

SEQ ID NO: 4035 - protein, 118 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGQLLPFADYWGQGTLVTVSS

SEQ ID NO: 4036 - protein, 11 aa, Artificial Sequence
  Description of Artificial Sequence: Synthetic peptide
ARGQLLPFADY

SEQ ID NO: 4037 - protein, 111 aa, Artificial Sequence
  Description of Artificial Sequence: Synthetic polypeptide
NFMLTQPHSVSESPGKTVTISCAGSSGSIASNYVQWYQQRPGSAPTTVIYEDNQRPSGVPDRFSGSIDSSSNSASLTISGLKTEDEADYYCQSYDSSKSWVFGGGTKLTVL

SEQ ID NO: 4038 - protein, 10 aa, Artificial Sequence
  Description of Artificial Sequence: Synthetic peptide
QSYDSSKSWV

SEQ ID NO: 4039 - protein, 120 aa, Artificial Sequence; identical to SEQ ID NO: 3891
  Description of Artificial Sequence: Synthetic polypeptide

SEQ ID NO: 4040 - protein, 13 aa, Artificial Sequence
  Description of Artificial Sequence: Synthetic peptide
VRDGGRPGDAFDI

SEQ ID NO: 4041 - protein, 110 aa, Artificial Sequence
  Description of Artificial Sequence: Synthetic polypeptide
QSVLTQPASVSGSPGQSITISCTGTSSDVGGYNYVSWYQQHPGKAPKLMIYDVSNRPSGVSNRFSGSKSGNTASLTISGLQAEDEADYYCNSYTSSSTRVFGTGTKVTVL

SEQ ID NO: 4042 - protein, 10 aa, Artificial Sequence
  Description of Artificial Sequence: Synthetic peptide
NSYTSSSTRV

SEQ ID NO: 4043 - protein, 122 aa, Artificial Sequence
  Description of Artificial Sequence: Synthetic polypeptide
QVQLQESGPGLVKPSETLSLTCTVSGGSISGYYWSWIRQPPGKGLEWIGYIYYSGSTNYNPSLKSRVTISVDTSKNQFSLKLSSVTAADTAVYYCARYGWGYDSSGYYFDYWGQGTLVTVSS

SEQ ID NO: 4044 - protein, 16 aa, Artificial Sequence
  Description of Artificial Sequence: Synthetic peptide
ARYGWGYDSSGYYFDY

SEQ ID NO: 4045 - protein, 110 aa, Artificial Sequence
  Description of Artificial Sequence: Synthetic polypeptide
QSVLTQPASVSGSPGQSITISCTGTSSDVGSYNLVSWYQEHPGKAPKLMIYEGSKRPSGVSNRFSGSKSGNTASLTISGLQAEDEADYYCCSYAGSSTWVFGGGTKLTVL

SEQ ID NO: 4046 - protein, 10 aa, Artificial Sequence
  Description of Artificial Sequence: Synthetic peptide
CSYAGSSTWV

SEQ ID NO: 4047 - protein, 127 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARVEDWGYCSSTNCYSGAFDIWGQGTMVTVSS

SEQ ID NO: 4048 - protein, 21 aa, Artificial Sequence
  Description of Artificial Sequence: Synthetic peptide
ARVEDWGYCSSTNCYSGAFDI

SEQ ID NO: 4049 - protein, 111 aa, Artificial Sequence
  Description of Artificial Sequence: Synthetic polypeptide
QSVLTQPPSVSEAPRQRVTISCSGSSSNIGNNAVNWYQQVPGKAPKLLIYYDDLLPSGVSDRFSGSKSGTSASLAISGLQSEDEADYYCAAWDDSLNGAWVFGGGTKLTVL

SEQ ID NO: 4050 - protein, 12 aa, Artificial Sequence
  Description of Artificial Sequence: Synthetic peptide
AAWDDSLNGAWV

SEQ ID NO: 4051 - protein, 132 aa, Artificial Sequence; identical to SEQ ID NO: 3939
  Description of Artificial Sequence: Synthetic polypeptide

SEQ ID NO: 4052 - protein, 24 aa, Artificial Sequence
  Description of Artificial Sequence: Synthetic peptide
ARERPGGTYSNTWYTPTDTNWFDT

SEQ ID NO: 4053 - protein, 108 aa, Artificial Sequence; identical to SEQ ID NO: 3941
  Description of Artificial Sequence: Synthetic polypeptide

SEQ ID NO: 4054 - protein, 11 aa, Artificial Sequence
  Description of Artificial Sequence: Synthetic peptide
QVWDSSRDHVV

SEQ ID NO: 4055 - protein, 127 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASGYTGYDYFVGGDYYGMDVWGQGTTVTVSS

SEQ ID NO: 4056 - protein, 20 aa, Artificial Sequence
  Description of Artificial Sequence: Synthetic peptide
ASGYTGYDYFVGGDYYGMDV

SEQ ID NO: 4057 - protein, 111 aa, Artificial Sequence
  Description of Artificial Sequence: Synthetic polypeptide
QSVLTQSPSASASLGASVKLTCTLSSGHSSYAIAWHQQQPEKGPRYLMKLNSDGSHSKGDGIPDRFSGSSSGAERYLTISSLQSEDEADYYCQTWGTGILVFGGGTKLTVL

SEQ ID NO: 4058 - protein, 9 aa, Artificial Sequence
  Description of Artificial Sequence: Synthetic peptide
QTWGTGILV

SEQ ID NO: 4059 - protein, 126 aa, Artificial Sequence
  Description of Artificial Sequence: Synthetic polypeptide
EVQLVQSGAEVKQPGESLKISCKALGYTFTTSWISWVRQMPGKGLEWMGRIDPSDSYTKYSPSFQGHVTISVDKSITTAYLQWSSLKASDSAVYYCATETNSETTDMFTGYSFDPWGQGTLVTVSS

SEQ ID NO: 4060 - protein, 19 aa, Artificial Sequence
  Description of Artificial Sequence: Synthetic peptide
ATETNSETTDMFTGYSFDP

SEQ ID NO: 4061 - protein, 110 aa, Artificial Sequence
  Description of Artificial Sequence: Synthetic polypeptide
QSVLTQPPSASGTPGQRVTIACSGSSSNIGSSPVKWYKQLPGTGPKLLIYSSNQRPSGVPDRFSGSKSGTSASLAISGLQSEDEADYYCAAWDDSLSGYVFGTGTKVTVL

SEQ ID NO: 4062 - protein, 11 aa, Artificial Sequence
  Description of Artificial Sequence: Synthetic peptide
AAWDDSLSGYV

SEQ ID NO: 4063 - protein, 121 aa, Artificial Sequence
  Description of Artificial Sequence: Synthetic polypeptide
QVQLVESGGGVVQPGRSLRLSCAASGFTFSRHAMHWVRQAPGKGLEWVAVISYDGSNKYYADSVKGRFTISRDNSKNTLYLQMNSLRAEDTAVYYCAREDYYDSSGSFDYWGQGTLVTVSS

SEQ ID NO: 4064 - protein, 14 aa, Artificial Sequence
  Description of Artificial Sequence: Synthetic peptide
AREDYYDSSGSFDY

SEQ ID NO: 4065 - protein, 110 aa, Artificial Sequence
  Description of Artificial Sequence: Synthetic polypeptide
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 4066 - protein, 10 aa, Artificial Sequence
  Description of Artificial Sequence: Synthetic peptide
SSYTSSSTWV

SEQ ID NO: 4067 - protein, 127 aa, Artificial Sequence
  Description of Artificial Sequence: Synthetic polypeptide
QVQLVESGGGVVQPGRSLRLSCAASGFTFSTYAMHWVRQAPGEGLEWVAVISYDGSNTYYADSVKGRFTISRDNSKNTLYLQMNSLRAEDTAVYYCARDPIWFGELLSPPFVHFDYWGQGTLVTVSS

SEQ ID NO: 4068 - protein, 20 aa, Artificial Sequence
  Description of Artificial Sequence: Synthetic peptide
ARDPIWFGELLSPPFVHFDY

SEQ ID NO: 4069 - protein, 113 aa, Artificial Sequence
  Description of Artificial Sequence: Synthetic polypeptide
QSVLTQPPSVSAAPGQKVTISCSGSSSNIGNNLVSWYQQLPGTAPKLLIYENNKRPSGIPDRFSGSKSGTSATLGITGLQTGDEADYYCGAWDSSLSAGGVYVFGTGTKVTVL

SEQ ID NO: 4070 - protein, 14 aa, Artificial Sequence
  Description of Artificial Sequence: Synthetic peptide
GAWDSSLSAGGVYV

SEQ ID NO: 4071 - protein, 124 aa, Artificial Sequence; identical to SEQ ID NO: 273
  Description of Artificial Sequence: Synthetic polypeptide

SEQ ID NO: 4072 - protein, 17 aa, Artificial Sequence
  Description of Artificial Sequence: Synthetic peptide
AKDPLPFRDFFYYYMDV

SEQ ID NO: 4073 - protein, 111 aa, Artificial Sequence; identical to SEQ ID NO: 274
  Description of Artificial Sequence: Synthetic polypeptide

SEQ ID NO: 4074 - protein, 11 aa, Artificial Sequence
  Description of Artificial Sequence: Synthetic peptide
SSYTSSSTLGV

SEQ ID NO: 4075 - protein, 121 aa, Artificial Sequence
  Description of Artificial Sequence: Synthetic polypeptide
QVQLLESGGGLVKPGGSLRLSCAASGFTFSDYYMSWIRQAPGKGLEWVSYISSRSSYTNYADSVKGRFTISRDNAKNSLYLQMNSLRAEDTAVYYCATYRSYLPLVQVDYWGQGTLVTVSS

SEQ ID NO: 4076 - protein, 14 aa, Artificial Sequence
  Description of Artificial Sequence: Synthetic peptide
ATYRSYLPLVQVDY

SEQ ID NO: 4077 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSKHAVFGGGTQLTVL

SEQ ID NO: 4078 - protein, 10 aa, Artificial Sequence
  Description of Artificial Sequence: Synthetic peptide
QSYDSSKHAV

SEQ ID NO: 4079 - protein, 129 aa, Artificial Sequence
  Description of Artificial Sequence: Synthetic polypeptide
QVQLVQSGAEVKKPGASVKVSCKASGYTFTGYYMHWVRQAPGQGLEWMGWISPVSGGTNYAQKFQGRVTMTRDTSISTAYMELSRLRSDDTAVYYCARAPLFPTGVLAGDYYYYGMDVWGQGTTVTVSS

SEQ ID NO: 4080 - protein, 22 aa, Artificial Sequence
  Description of Artificial Sequence: Synthetic peptide
ARAPLFPTGVLAGDYYYYGMDV

SEQ ID NO: 4081 - protein, 110 aa, Artificial Sequence
  Description of Artificial Sequence: Synthetic polypeptide
QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSSTLVFGGGTKLTVL

SEQ ID NO: 4082 - protein, 10 aa, Artificial Sequence
  Description of Artificial Sequence: Synthetic peptide
CSYAGSSTLV

SEQ ID NO: 4083 - protein, 120 aa, Artificial Sequence
  Description of Artificial Sequence: Synthetic polypeptide
QVQLVQSGAEVKKPGASVKVSCKTSGYNFPSYGISWVRQAPGEGLEWMGWINPYNDNTNYAQRVQGRVTMTTDTSTGTAYMEVKSLRSDDTAVYYCARDGYGDYRAYDYWGLGTLVTVSS

SEQ ID NO: 4084 - protein, 13 aa, Artificial Sequence
  Description of Artificial Sequence: Synthetic peptide
ARDGYGDYRAYDY

SEQ ID NO: 4085 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFGGSGSGTDFTLTISSLQPEDFATYFCQQSFITPRTFGQGTKVEIK

SEQ ID NO: 4086 - protein, 9 aa, Artificial Sequence
  Description of Artificial Sequence: Synthetic peptide
QQSFITPRT

SEQ ID NO: 4087 - protein, 124 aa, Artificial Sequence
  Description of Artificial Sequence: Synthetic polypeptide
QVQLVQSGAEVKTPGASVKVSCKASGYTFTSYGISWVRQAPGQGLEWMGWVSSYNGNTNYAQKFQGRVTMTTDTSTNTVHMELWNLRSDDTAVYYCARVEYYYDSSGTYYFDHWGQGTLVTVSS

SEQ ID NO: 4088 - protein, 17 aa, Artificial Sequence
  Description of Artificial Sequence: Synthetic peptide
ARVEYYYDSSGTYYFDH

SEQ ID NO: 4089 - protein, 109 aa, Artificial Sequence
  Description of Artificial Sequence: Synthetic polypeptide
EIVMTQSPATLSVSPGERATLSCRASQSISSNVAWYQQKPGQAPRFLLYGASTRATGIPARFSGSGSGTEFTLTITSLQSEDFAVYYCQQYDDWPPKWTFGQGTKVEIK

SEQ ID NO: 4090 - protein, 11 aa, Artificial Sequence
  Description of Artificial Sequence: Synthetic peptide
QQYDDWPPKWT

SEQ ID NO: 4091 - protein, 122 aa, Artificial Sequence
  Description of Artificial Sequence: Synthetic polypeptide
EVQLVESGGGLIQPGGSLRLSCAASGFTVSSNYMTWARQAPGKGLEWVSVIYSGGTTYYADSVKGRFTISRDKSKSTLYLQMSSLRAEDTAVYYCAVRGFRELYYPHGMEVWGQGTTVTVSS

SEQ ID NO: 4092 - protein, 16 aa, Artificial Sequence
  Description of Artificial Sequence: Synthetic peptide
AVRGFRELYYPHGMEV

SEQ ID NO: 4093 - protein, 106 aa, Artificial Sequence
  Description of Artificial Sequence: Synthetic polypeptide
DIQMTQSPSSLSASVGDRVTITCQASQDITNYLNWYQQKPGKAPKLLIYDASTLEAGVPSRFSGSGSGTEFTFTISSLQPEDIATYYCQHYENLPPGFGPGTRVDF

SEQ ID NO: 4094 - protein, 9 aa, Artificial Sequence
  Description of Artificial Sequence: Synthetic peptide
QHYENLPPG

SEQ ID NO: 4095 - protein, 122 aa, Artificial Sequence
  Description of Artificial Sequence: Synthetic polypeptide
QVQLVESGGGVVQPGGSLRLSCAASAFTFSSYAMHWIRQSPGKGLEWVAVISSDGSSKFYADSVKGRFTISRDNSKNTLYLQMNSLSAEDTAVYYCARDLENVLIEVALQDWGQGTLVTVSS

SEQ ID NO: 4096 - protein, 15 aa, Artificial Sequence
  Description of Artificial Sequence: Synthetic peptide
ARDLENVLIEVALQD

SEQ ID NO: 4097 - protein, 108 aa, Artificial Sequence
  Description of Artificial Sequence: Synthetic polypeptide
DIQMTQSPSSLSASVGDRVTITCRASQSINSYLNWYQQKPGKAPKLLIYAASSLHSGVPSRFSGSGSGTDFTLTISSLQPEDFATYYCQQSYTTLALTFGGGTKVEIK

SEQ ID NO: 4098 - protein, 10 aa, Artificial Sequence
  Description of Artificial Sequence: Synthetic peptide
QQSYTTLALT

SEQ ID NO: 4099 - protein, 119 aa, Artificial Sequence; identical to SEQ ID NO: 283
  Description of Artificial Sequence: Synthetic polypeptide

SEQ ID NO: 4100 - protein, 13 aa, Artificial Sequence
  Description of Artificial Sequence: Synthetic peptide
ARPVVGGRAGMDV

SEQ ID NO: 4101 - protein, 107 aa, Artificial Sequence; identical to SEQ ID NO: 284
  Description of Artificial Sequence: Synthetic polypeptide

SEQ ID NO: 4102 - protein, 9 aa, Artificial Sequence
  Description of Artificial Sequence: Synthetic peptide
LHNDNPPLT

SEQ ID NO: 4103 - protein, 125 aa, Artificial Sequence; identical to SEQ ID NO: 295
  Description of Artificial Sequence: Synthetic polypeptide

SEQ ID NO: 4104 - protein, 17 aa, Artificial Sequence
  Description of Artificial Sequence: Synthetic peptide
ARDAIGSASYGVEYFQH

SEQ ID NO: 4105 - protein, 109 aa, Artificial Sequence; identical to SEQ ID NO: 296
  Description of Artificial Sequence: Synthetic polypeptide

SEQ ID NO: 4106 - protein, 10 aa, Artificial Sequence
  Description of Artificial Sequence: Synthetic peptide
QQYGSSPPYT

SEQ ID NO: 4107 - protein, 123 aa, Artificial Sequence
  Description of Artificial Sequence: Synthetic polypeptide
QVQLVESGGGVVQPGRSLRLSCAASGFSFSTYGMHWVRQAPGKGLEWVAVISYDGSNKYSADSVKGRFTISRDNSKNTLYLQMNSLRAEDTAVYYCAKDIGGSYYLMYYFDYWGQGTLVTVSS

SEQ ID NO: 4108 - protein, 16 aa, Artificial Sequence
  Description of Artificial Sequence: Synthetic peptide
AKDIGGSYYLMYYFDY

SEQ ID NO: 4109 - protein, 108 aa, Artificial Sequence
  Description of Artificial Sequence: Synthetic polypeptide
DIQMTQSPSSLSAFVGDRVTITCQASQDIGNYLNWYQQKPGKPPKLLIYDASNLEAGVPSRFSGSGSGTDFTFTISSLQPEDIATYYCQQYDILPPITFGQGTRLEIK

SEQ ID NO: 4110 - protein, 10 aa, Artificial Sequence
  Description of Artificial Sequence: Synthetic peptide
QQYDILPPIT

SEQ ID NO: 4111 - protein, 120 aa, Artificial Sequence
  Description of Artificial Sequence: Synthetic polypeptide
  MOD_RES (60)..(60): Any amino acid
  MOD_RES (65)..(65): Any amino acid
  MOD_RES (69)..(71): Any amino acid
QVQLVESGGGLVKPGGSLRLSCAASGFTFSEYYMSWIRQAPGKGAEVGLCGSSSRTWRIXADFVXSLWXXXQDNAKNSLYLQMNSLRAEDTAVYYCAREQQLPINWFDTWGQGTLVTVSS

SEQ ID NO: 4112 - protein, 13 aa, Artificial Sequence
  Description of Artificial Sequence: Synthetic peptide
AREQQLPINWFDT

SEQ ID NO: 4113 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTITSLEPEDFAVYYCQQRSNWPSTFGGGTKVEIK

SEQ ID NO: 4114 - protein, 9 aa, Artificial Sequence
  Description of Artificial Sequence: Synthetic peptide
QQRSNWPST

SEQ ID NO: 4115 - protein, 127 aa, Artificial Sequence
  Description of Artificial Sequence: Synthetic polypeptide
EVQLVESGGGLVQPGGSLRLSCAASGFTFSTYDMHWVRQPTGKGLEWVSAIGSGGDTYYAGSVKGRFTISRESAKNSLYLQMNSLTAGDTAVYYCARGDHKSGWSEHRSFYFYYMDVWGKGTTVTVS

SEQ ID NO: 4116 - protein, 22 aa, Artificial Sequence
  Description of Artificial Sequence: Synthetic peptide
ARGDHKSGWSEHRSFYFYYMDV

SEQ ID NO: 4117 - protein, 108 aa, Artificial Sequence
  Description of Artificial Sequence: Synthetic polypeptide
DIQMTQSPSSLSASVGDRVTVTCRASQSISTYLNWYQLKPGKAPNLLIYGTSSLQVGVPSRFIGSGSGTDFTLTISSVQPEDFATYYCQQSYITTAYTFGQGTKLEIK

SEQ ID NO: 4118 - protein, 10 aa, Artificial Sequence
  Description of Artificial Sequence: Synthetic peptide
QQSYITTAYT

SEQ ID NO: 4119 - protein, 123 aa, Artificial Sequence
  Description of Artificial Sequence: Synthetic polypeptide
QVQLVESGGGVVQPGRSLRLSCAASGITFSHYGMHWVRQAPGKGLEWVALISSDGSKKYYADSVKGRFTISRDNSKNTVYLQMNSLRAEDTALYYCAKDLGYYYGPPYGPDYWGQGTLVTVSS

SEQ ID NO: 4120 - protein, 16 aa, Artificial Sequence
  Description of Artificial Sequence: Synthetic peptide
AKDLGYYYGPPYGPDY

SEQ ID NO: 4121 - protein, 108 aa, Artificial Sequence
  Description of Artificial Sequence: Synthetic polypeptide
DIQMTQSPSSLSASVGDRVTITCQASQDVSNSLNWYQQKPGKAPKLLIYGASNLETGVPSRFSGSGSGTDFSFTISSLQPEDIATYYCLQYDNFSMYTFGQGTKLEIK

SEQ ID NO: 4122 - protein, 10 aa, Artificial Sequence
  Description of Artificial Sequence: Synthetic peptide
LQYDNFSMYT

SEQ ID NO: 4123 - protein, 127 aa, Artificial Sequence
  Description of Artificial Sequence: Synthetic polypeptide
QVQLVESGGGVVQPGRSLRLSCAASGFTFSNYGMHWVRQAPGKGLEWVAVISYDGSNKYYADSVKGRFTISRDNSKNTLYLQMNSLRAEDTAVFYCAKQTAPYCSGGNCYSGYFDYWGQGTLVTVSS

SEQ ID NO: 4124 - protein, 20 aa, Artificial Sequence
  Description of Artificial Sequence: Synthetic peptide
AKQTAPYCSGGNCYSGYFDY

SEQ ID NO: 4125 - protein, 110 aa, Artificial Sequence
  Description of Artificial Sequence: Synthetic polypeptide
DIQMTQSPSSLSASVGDRVTITCRASQSISSYLNWYQQKPGKAPRLLIYAASYLHSGVPSRFSGSGSATDFTLTISSLQPEDFATYYCQQSYSAPPGPYTFGQGTKLEIK

SEQ ID NO: 4126 - protein, 12 aa, Artificial Sequence
  Description of Artificial Sequence: Synthetic peptide
QQSYSAPPGPYT

SEQ ID NO: 4127 - protein, 116 aa, Artificial Sequence
  Description of Artificial Sequence: Synthetic polypeptide
EVQLVESGGGLIQPGGSPRLSCAASGITVSSNYMSWVRQAPGKGLEWISVIYSGGSTFYADSVKGRFTISRDDSKNTLYLQMHSLRADDTAMYYCARAVWDAFDIWGQGTMVTVSS

SEQ ID NO: 4128 - protein, 10 aa, Artificial Sequence
  Description of Artificial Sequence: Synthetic peptide
ARAVWDAFDI

SEQ ID NO: 4129 - protein, 109 aa, Artificial Sequence
  Description of Artificial Sequence: Synthetic polypeptide
DIQLTQSPSFLSASVGDRVTITCRASQGISSYLAWYQQKPGKAPKLLIYTASTLQSGVPSRFSGSGSGTEFTLTISSLQPEDFATYYCQHLNSYPSPNTFGQGTKLEIK

SEQ ID NO: 4130 - protein, 11 aa, Artificial Sequence
  Description of Artificial Sequence: Synthetic peptide
QHLNSYPSPNT

SEQ ID NO: 4131 - protein, 123 aa, Artificial Sequence
  Description of Artificial Sequence: Synthetic polypeptide
QVQLVESGGGVVQPGRSLRLSCAASGFTFSTYGMHWVRQAPGKGLEWVTVISYDGSNKYYSDSVKGRFTISRDNSQNTLYLQMNSLSAEDTAVYYCAKSISPYTSGWYYFDYWGQGTLVTVSS

SEQ ID NO: 4132 - protein, 16 aa, Artificial Sequence
  Description of Artificial Sequence: Synthetic peptide
AKSISPYTSGWYYFDY

SEQ ID NO: 4133 - protein, 107 aa, Artificial Sequence
  Description of Artificial Sequence: Synthetic polypeptide
DIQMTQSPSSLSASVGDRVTITCQASQDISNYLNWYQQKPGKVPKLLIYDASSLETGVPSRFSGSGSGTNFTFTISSLQPEDIATYYCLQYNNLPLTFGGGTKVEIK

SEQ ID NO: 4134 - protein, 9 aa, Artificial Sequence
  Description of Artificial Sequence: Synthetic peptide
LQYNNLPLT

SEQ ID NO: 4135 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVILSDGSGKLYADSVKGRFTISRDNSKSTLYLQMSSLRAEDSAVYYCARDGPPTSLVTCPDFWGQGTLVTVSS

SEQ ID NO: 4136 - protein, 15 aa, Artificial Sequence
  Description of Artificial Sequence: Synthetic peptide
ARDGPPTSLVTCPDF

SEQ ID NO: 4137 - protein, 107 aa, Artificial Sequence
  Description of Artificial Sequence: Synthetic polypeptide
DIQMTQSPSSLSASVGDRVTITCRASQSIGSYLNWYQQKPGKAPKLLIYAASSLQSGVPSRFSGSGSGTDFTLTISSLQREDFATYYCQQSYSTPPWTFGQGTTVDI

SEQ ID NO: 4138 - protein, 10 aa, Artificial Sequence
  Description of Artificial Sequence: Synthetic peptide
QQSYSTPPWT

SEQ ID NO: 4139 - protein, 124 aa, Artificial Sequence
  Description of Artificial Sequence: Synthetic polypeptide
EVQLVESGGGLVQPGGSLRVSCAASGFTFKSYDMHWVRQVTGKGLEWVSVIGTAGDTYYLDSVKGRFTISRENAKNSLYLQMNSLTAGDTAIYYCARGDMATRRPFYYYYMDVWGKGTAVTVSS

SEQ ID NO: 4140 - protein, 18 aa, Artificial Sequence
  Description of Artificial Sequence: Synthetic peptide
ARGDMATRRPFYYYYMDV

SEQ ID NO: 4141 - protein, 108 aa, Artificial Sequence
  Description of Artificial Sequence: Synthetic polypeptide
DIQMTQSPSSLSASVGDRVTITCRASQTISRYLNWYQQKPGEAPRLLIFAASTLQSGVPTRFSGSGSGTDFTLTITSLQPEDFATYWCQQSYSNPNLTFGGGTKVEIK

SEQ ID NO: 4142 - protein, 10 aa, Artificial Sequence
  Description of Artificial Sequence: Synthetic peptide
QQSYSNPNLT

SEQ ID NO: 4143 - protein, 118 aa, Artificial Sequence
  Description of Artificial Sequence: Synthetic polypeptide
EVQLVESGGGLIQPGGSLRLSCAASGLIVSSNYMNWVRQAPGKGLEWVSLIYSGGSTYYADSVKGRFTISRDNSKNTLYLQMNSLRPEDTAVYYCARDFSVVGAFDIWGQGTVVTVSS

SEQ ID NO: 4144 - protein, 12 aa, Artificial Sequence
  Description of Artificial Sequence: Synthetic peptide
ARDFSVVGAFDI

SEQ ID NO: 4145 - protein, 109 aa, Artificial Sequence
  Description of Artificial Sequence: Synthetic polypeptide
EIVLTQSPGTLSLSPGERATLSCRASQSLPSTYLAWYQQKPGQAPRLLIYGASSRATGIPDRFSGSGSGTDFTLTISRLEPEDFAVYYCQQYGTSPRVTFGPGTKVDIK

SEQ ID NO: 4146 - protein, 10 aa, Artificial Sequence
  Description of Artificial Sequence: Synthetic peptide
QQYGTSPRVT

SEQ ID NO: 4147 - protein, 127 aa, Artificial Sequence
  Description of Artificial Sequence: Synthetic polypeptide
QVQLVESGGGVVQPGKSLRLSCAASGFTFSRYGMHWVRRAPGKGLEWVAGISYDGSNKYYADSVKGRFTISRDNSKNTLYLQMNSLRAEDTALFFCAKVSGPYCSGHSCYSATFDYWGQGTLVTVSS

SEQ ID NO: 4148 - protein, 20 aa, Artificial Sequence
  Description of Artificial Sequence: Synthetic peptide
AKVSGPYCSGHSCYSATFDY

SEQ ID NO: 4149 - protein, 107 aa, Artificial Sequence
  Description of Artificial Sequence: Synthetic polypeptide
DIQMTQSPSSLSASVGDRVTIICQASQDISNYLNWYQQKPGKAPKLLIYDASNLETGVPSRFSGSGSGTDFAFTISGLQPEDIATYYCQQYDHLPPTFGQGTKVEIK

SEQ ID NO: 4150 - protein, 9 aa, Artificial Sequence
  Description of Artificial Sequence: Synthetic peptide
QQYDHLPPT

SEQ ID NO: 4151 - protein, 122 aa, Artificial Sequence; identical to SEQ ID NO: 271
  Description of Artificial Sequence: Synthetic polypeptide

SEQ ID NO: 4152 - protein, 15 aa, Artificial Sequence
  Description of Artificial Sequence: Synthetic peptide
ATFHVAYGDYIPFDS

SEQ ID NO: 4153 - protein, 109 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGRSPTWTFGQGTKVEIE

SEQ ID NO: 4154 - protein, 10 aa, Artificial Sequence
  Description of Artificial Sequence: Synthetic peptide
QQYGRSPTWT

SEQ ID NO: 4155 - protein, 129 aa, Artificial Sequence
  Description of Artificial Sequence: Synthetic polypeptide
QVQLVQSGAEVKKPGASVKVSCKASGYTFTSYALHWVRQAPGQRLEWMGWINVGNGTTKYSQKFQGRVTITRDTSASTAYMELSSLRSDDTAVYYCARVPRGYYDRSGHYHGQDYFDYWGQGTLVTVSS

SEQ ID NO: 4156 - protein, 22 aa, Artificial Sequence
  Description of Artificial Sequence: Synthetic peptide
ARVPRGYYDRSGHYHGQDYFDY

SEQ ID NO: 4157 - protein, 108 aa, Artificial Sequence
  Description of Artificial Sequence: Synthetic polypeptide
EIVLTQSPGTLSLSPGERATLSCRASQSLSSNYLAWYQQKPGQAPRLLIYGASSRATAIPDRLSGSGSGTDFTLTISRLEPEDFAVYYCQQYGSSPITFGQGTRLEIK

SEQ ID NO: 4158 - protein, 9 aa, Artificial Sequence
  Description of Artificial Sequence: Synthetic peptide
QQYGSSPIT

SEQ ID NO: 4159 - protein, 115 aa, Artificial Sequence; identical to SEQ ID NO: 289
  Description of Artificial Sequence: Synthetic polypeptide

SEQ ID NO: 4160 - protein, 9 aa, Artificial Sequence
  Description of Artificial Sequence: Synthetic peptide
ARHPYGTDV

SEQ ID NO: 4161 - protein, 107 aa, Artificial Sequence
  Description of Artificial Sequence: Synthetic polypeptide
  MOD_RES (33)..(33): Any amino acid
DIQMTQSPSSLSASVGDRVTITCQASQDIVKYXNWYQQKSGKAPKLLIHDASNLETGVTSRFSGSGSGTHFTFTISSLQPEDLATYYCQQYDNLPITFGQGTRLEIK

SEQ ID NO: 4162 - protein, 9 aa, Artificial Sequence
  Description of Artificial Sequence: Synthetic peptide
QQYDNLPIT

SEQ ID NO: 4163 - protein, 123 aa, Artificial Sequence
  Description of Artificial Sequence: Synthetic polypeptide
QVQLVQSGAEVKKPGASVKVSCKASGDTFTSYDINWVRQATGQGLEWMGWMNRNSGNTDYAQKFQGRVTMTRNTSISTAYMELSSLRSEDTAVYYCVSRRWDPLRFYYYMDVWGKGTTVTVSS

SEQ ID NO: 4164 - protein, 16 aa, Artificial Sequence
  Description of Artificial Sequence: Synthetic peptide
VSRRWDPLRFYYYMDV

SEQ ID NO: 4165 - protein, 111 aa, Artificial Sequence
  Description of Artificial Sequence: Synthetic polypeptide
DIVMTQSPLSLPVTPGEPASISCRSSQSLLHSNGYNYLDWFLQKPGQSPQLLIYLGSNRASGVPDRFSGSGSGTDFTLKISRVEAEDVGVYYCMQALQTPPTFGGGTKVEI

SEQ ID NO: 4166 - protein, 9 aa, Artificial Sequence
  Description of Artificial Sequence: Synthetic peptide
MQALQTPPT

SEQ ID NO: 4167 - protein, 120 aa, Artificial Sequence
  Description of Artificial Sequence: Synthetic polypeptide
QVQLVESGGGVVQPGGSLRLSCAASGFTFRNYGMHWVRQAPGKGLECVAVIWYDGSNKYYGDSVKGRFTISRDNSKNTLYLQMNSLRAEDTALYYCARDNEITAIDIDYWGQGTLVTVSS

SEQ ID NO: 4168 - protein, 13 aa, Artificial Sequence
  Description of Artificial Sequence: Synthetic peptide
ARDNEITAIDIDY

SEQ ID NO: 4169 - protein, 112 aa, Artificial Sequence
  Description of Artificial Sequence: Synthetic polypeptide
DVVMTQSPLSLPVTLGQPASISCRSSQSLVHSDGNTYLNWFQQRPGQSPRRLIYKVSNRDSGVPDRFSGSGSGTYFTLKISRVEAEDVGVYYCMQGTHWPGTFGPGTKVDIK

SEQ ID NO: 4170 - protein, 9 aa, Artificial Sequence
  Description of Artificial Sequence: Synthetic peptide
MQGTHWPGT

SEQ ID NO: 4171 - protein, 123 aa, Artificial Sequence; identical to SEQ ID NO: 303
  Description of Artificial Sequence: Synthetic polypeptide

SEQ ID NO: 4172 - protein, 16 aa, Artificial Sequence
  Description of Artificial Sequence: Synthetic peptide
ASRRWDPLTFYYYMVV

SEQ ID NO: 4173 - protein, 112 aa, Artificial Sequence
  Description of Artificial Sequence: Synthetic polypeptide
DIVMTQSPLSLPVTPGEPASISCRSSQSLLYSNGYNYLDWYLQKPGQSPQLLIYLGSNRASGVPDRFSGSGSGTDFTLKISRVEAEDVGVYFCMQALQTPPTFGGGTKVEIK

SEQ ID NO: 4174 - protein, 9 aa, Artificial Sequence
  Description of Artificial Sequence: Synthetic peptide
MQALQTPPT

SEQ ID NO: 4175 - protein, 132 aa, Artificial Sequence
  Description of Artificial Sequence: Synthetic polypeptide
QVQLVESGGGVVQPGRSLRLSCAASGFSFSSYAMHWVRQAPGKGLEWVAVISYDETNKYYGDSVKGRFTISRDNSKNTLYLQMNSLRAEDTAVYNCARVLGRGSVAGNIKSTLFGLDAFDIWGQGTMVTVSS

SEQ ID NO: 4176 - protein, 25 aa, Artificial Sequence
  Description of Artificial Sequence: Synthetic peptide
ARVLGRGSVAGNIKSTLFGLDAFDI

SEQ ID NO: 4177 - protein, 109 aa, Artificial Sequence
  Description of Artificial Sequence: Synthetic polypeptide
EIVMTQSPATLSVSPGESATLSCRASQSVSSNLAWYQQKPGQAPRLLIYGASTRATGIPARFSGSGSGTEFTLTISSLQSEDFAVYYCQQYNNWPPAFTFGPGTKVDIK

SEQ ID NO: 4178 - protein, 11 aa, Artificial Sequence
  Description of Artificial Sequence: Synthetic peptide
QQYNNWPPAFT

SEQ ID NO: 4179 - protein, 123 aa, Artificial Sequence
  Description of Artificial Sequence: Synthetic polypeptide
QMQLVQSGPEVKKPGTSVKVSCKASGFIFSSSAVQWVRQARGQRLEWIGWIVVGSGNTNYAQKFQERVTISRDMSTSTAYIHLSSLRSEDTAVYYCAAPSCTSTICYDAFNIWGQGTMVTVSS

SEQ ID NO: 4180 - protein, 16 aa, Artificial Sequence
  Description of Artificial Sequence: Synthetic peptide
AAPSCTSTICYDAFNI

SEQ ID NO: 4181 - protein, 108 aa, Artificial Sequence
  Description of Artificial Sequence: Synthetic polypeptide
EIVLTQSPGTLSLSQGERATLSCRASQSVRSSYLAWYQQKPGQAPRLLIYGASIRATGIPDRFSGSGSGTDFTLTISRLEPEDFAVYYCQHYGGSLFTFGPGTKVDIK

SEQ ID NO: 4182 - protein, 9 aa, Artificial Sequence
  Description of Artificial Sequence: Synthetic peptide
QHYGGSLFT

SEQ ID NO: 4183 - protein, 129 aa, Artificial Sequence
  Description of Artificial Sequence: Synthetic polypeptide
QVQLVESGGGVVQPGRSLRLSCAASGFTFRSHAMHWVRQAPGKGLEWVAIISSDGFNKYYADSVKGRFTISRDNSKNTLYVHMNSLRVEDTAIYYCASGLLWFETREISGAPDYGMAVWGQGATVTVSS

SEQ ID NO: 4184 - protein, 22 aa, Artificial Sequence
  Description of Artificial Sequence: Synthetic peptide
ASGLLWFETREISGAPDYGMAV

SEQ ID NO: 4185 - protein, 107 aa, Artificial Sequence
  Description of Artificial Sequence: Synthetic polypeptide
DIQMTQSPSSLSASVGDRVTITCRASQNISNFLNWYQQKPGKAPKLLIYAASSLQSGVPSRYSGSGSGTDFTLTISSLQAEDFATYYCQQSYSTPLTFGGGTKVEIK

SEQ ID NO: 4186 - protein, 9 aa, Artificial Sequence
  Description of Artificial Sequence: Synthetic peptide
QQSYSTPLT

SEQ ID NO: 4187 - protein, 117 aa, Artificial Sequence
  Description of Artificial Sequence: Synthetic polypeptide
EVQLVESGGGLIQPGGSLRLSCAASGVTVSSNYMNWVRQAPGKGLEWVSVIYSGGSTFYADSVKGRFTISRDNSKNTLYLQMNSLRAEDTAVYYCARESYHSAFDIWGQGTMVTVSS

SEQ ID NO: 4188 - protein, 11 aa, Artificial Sequence
  Description of Artificial Sequence: Synthetic peptide
ARESYHSAFDI

SEQ ID NO: 4189 - protein, 109 aa, Artificial Sequence
  Description of Artificial Sequence: Synthetic polypeptide
DIQLTQSPSFLSASVGDRVTITCRASQGISSYLAWYQQKPGKAPKLLIYGASTLQSGVPSRFSGSGSGTEFTLTINSLQSEDFATYYCQQLNSYPPRDTFGQGTKLEIK

SEQ ID NO: 4190 - protein, 11 aa, Artificial Sequence
  Description of Artificial Sequence: Synthetic peptide
QQLNSYPPRDT

SEQ ID NO: 4191 - protein, 129 aa, Artificial Sequence
  Description of Artificial Sequence: Synthetic polypeptide
EVQLVQSGAEVKKPGESLRISCKGSGYSFTSYWISWVRQMPGKGLEWMGRIDPSDSYTNYSPPFQGHVTFSADKSISTAYLHWSSLKASDTAIYYCARPPRYYYDRSGYYVWEDYFDYWGQGTLVTVSS

SEQ ID NO: 4192 - protein, 22 aa, Artificial Sequence
  Description of Artificial Sequence: Synthetic peptide
ARPPRYYYDRSGYYVWEDYFDY

SEQ ID NO: 4193 - protein, 108 aa, Artificial Sequence
  Description of Artificial Sequence: Synthetic polypeptide
EIVLTQSPGTLSLSPGESATLSCRASQSVSSSYLAWYQQKPGQAPRLLIYGASSRATGIPDRFSGSGSGTDFTLTISRLEPEDFAVYYCQQYGSSPYTFGQGTKLEVK

SEQ ID NO: 4194 - protein, 9 aa, Artificial Sequence
  Description of Artificial Sequence: Synthetic peptide
QQYGSSPYT

SEQ ID NO: 4195 - protein, 123 aa, Artificial Sequence
  Description of Artificial Sequence: Synthetic polypeptide
EVQLVESGGGLVQPGGSLRLSCAASGFTFSTYDMHWVRQATGKGLEWVSAIGTAGDKYYPGSVKGRFTISRENAKNSLYLQMNSLRAGDTAVYYCVRAGYSSGWPLYWYFDLWGRGTLVSVSS

SEQ ID NO: 4196 - protein, 17 aa, Artificial Sequence
  Description of Artificial Sequence: Synthetic peptide
VRAGYSSGWPLYWYFDL

SEQ ID NO: 4197 - protein, 109 aa, Artificial Sequence; identical to SEQ ID NO: 286
  Description of Artificial Sequence: Synthetic polypeptide

SEQ ID NO: 4198 - protein, 11 aa, Artificial Sequence
  Description of Artificial Sequence: Synthetic peptide
QQSYRTPPEFT

SEQ ID NO: 4199 - protein, 123 aa, Artificial Sequence
  Description of Artificial Sequence: Synthetic polypeptide
QVQLVQSGAEVKKPGASVKVSCTASGYTFSSYYIHWVRQAPGQGLEWMGIINPGAGSTTYAQKFQGRVAMTTDTSTRTVYMELSSLRSDDTAVYYCGRDEAFLPSAIFVGDYWGQGTLVTVSS

SEQ ID NO: 4200 - protein, 16 aa, Artificial Sequence
  Description of Artificial Sequence: Synthetic peptide
GRDEAFLPSAIFVGDY

SEQ ID NO: 4201 - protein, 109 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPHTWTFGQGTKVEIK

SEQ ID NO: 4202 - protein, 11 aa, Artificial Sequence
  Description of Artificial Sequence: Synthetic peptide
LQHNSYPHTWT

SEQ ID NO: 4203 - protein, 119 aa, Artificial Sequence
  Description of Artificial Sequence: Synthetic polypeptide
QVQLVESGGGLVKPGGSLRLSCAGSGFTFTDYYMAWIRQAPGKGLEWVSYISTSDRFINYADSVKGRFTISRDDAKNSLYLQMNSLRAEDTAVYYCARDGGGYDRFDHWGQGTLVTVSS

SEQ ID NO: 4204 - protein, 12 aa, Artificial Sequence
  Description of Artificial Sequence: Synthetic peptide
ARDGGGYDRFDH

SEQ ID NO: 4205 - protein, 107 aa, Artificial Sequence
  Description of Artificial Sequence: Synthetic polypeptide
DIQMTQSPSSLSASVGDRVTITCQASQDISNLLNWYQQKAGKAPKLLIYDASNLETGVPSRFSGSGSGTDFTFTISSLQPEDIATYYCLQYDNLPLTFGQGTRLEIK

SEQ ID NO: 4206 - protein, 9 aa, Artificial Sequence
  Description of Artificial Sequence: Synthetic peptide
LQYDNLPLT

SEQ ID NO: 4207 - protein, 128 aa, Artificial Sequence
  Description of Artificial Sequence: Synthetic polypeptide
EVQLVESGGGLVQPGGSLRLSCAASGFTFNNYDMHWVRQGTGKRLQWVSVIGTSGDTYYSDSVKGRFTISRENAKNSLYLQMNSLRAGDTAVYYCVRGTTVVRGLIEKYYHYYVMDVWGQGTTVTVSS

SEQ ID NO: 4208 - protein, 22 aa, Artificial Sequence
  Description of Artificial Sequence: Synthetic peptide
VRGTTVVRGLIEKYYHYYVMDV

SEQ ID NO: 4209 - protein, 108 aa, Artificial Sequence
  Description of Artificial Sequence: Synthetic polypeptide
DIQMTQSPSSLSASVGDRVTITCRASQSISSYLNWYQQKIGKAPKLLIYAASSLQSGVPSRFSGSGSGTDFTLTISSLQPEDFATYYCQQSYSNPGWTFGQGTKVEIK

SEQ ID NO: 4210 - protein, 10 aa, Artificial Sequence
  Description of Artificial Sequence: Synthetic peptide
QQSYSNPGWT

SEQ ID NO: 4211 - protein, 117 aa, Artificial Sequence
  Description of Artificial Sequence: Synthetic polypeptide
EVQLVESGGGLFQPGGSLKLSCVASGLTVSANYMNWVRQAPGKGLEWVSVIYSGGSAFYADSVKGRFTISRDISKNTLFLQMNTLRAEDTAVYYCARDLVVYGMDVWGQGTTVIVSS

SEQ ID NO: 4212 - protein, 11 aa, Artificial Sequence
  Description of Artificial Sequence: Synthetic peptide
ARDLVVYGMDV

SEQ ID NO: 4213 - protein, 107 aa, Artificial Sequence
  Description of Artificial Sequence: Synthetic polypeptide
DIQLTQSPSFLSASVGDRVTITCRARQGISNFLAWYQQKPGRAPKLLIYGASTLQSGVPSRFSGSGSGTEFTLTISSLQPEDFATYYCQQLNSDPITFGQGTRLEIK

SEQ ID NO: 4214 - protein, 9 aa, Artificial Sequence
  Description of Artificial Sequence: Synthetic peptide
QQLNSDPIT

SEQ ID NO: 4215 - protein, 124 aa, Artificial Sequence
  Description of Artificial Sequence: Synthetic polypeptide
EVQLVESGGGLIQPGVSLRLSCAVSGFTVSRNYMSWVRQAPGKGLEWVSVIYPGGSTFYADSVKGRFTISRDNSKNTLHLQMNSLRAEDTAVYYCARDFYRPTTFRGEAKGDYWGQGTLVTVSS

SEQ ID NO: 4216 - protein, 18 aa, Artificial Sequence
  Description of Artificial Sequence: Synthetic peptide
ARDFYRPTTFRGEAKGDY

SEQ ID NO: 4217 - protein, 107 aa, Artificial Sequence
  Description of Artificial Sequence: Synthetic polypeptide
DIQMTQSPSSLSASVGDRVTITCQASQDINNYLNWYQQKPGEAPKLLIYDASNLETGVPSRFSGSGSGTDFTFTISSLQPEDIATYYCHQYDNLPRTFGQGTKVEIK

SEQ ID NO: 4218 - protein, 9 aa, Artificial Sequence
  Description of Artificial Sequence: Synthetic peptide
HQYDNLPRT

SEQ ID NO: 4219 - protein, 120 aa, Artificial Sequence
  Description of Artificial Sequence: Synthetic polypeptide
QVQLVESGGALVKPGGSLRLSCAASGFTFSDHYMSWIRQAPGRGLEWVSYISTSSSDTSYADSVKGRFTISRDNAKNSLFLQMNSLRAEDTAVYYCARDSEWLQFASFDYWGQGTLVTVS

SEQ ID NO: 4220 - protein, 14 aa, Artificial Sequence
  Description of Artificial Sequence: Synthetic peptide
ARDSEWLQFASFDY

SEQ ID NO: 4221 - protein, 107 aa, Artificial Sequence
  Description of Artificial Sequence: Synthetic polypeptide
EIVLTQSPGTLSLSPGERATLSCRASQSVSSSYLAWYQQKPGQAPRLVIYGAISRAAGIPDRFSGSGSETDFTLTISRLEPEDFAVYYCQQYGSSHTFGQGTRLEIK

SEQ ID NO: 4222 - protein, 8 aa, Artificial Sequence
  Description of Artificial Sequence: Synthetic peptide
QQYGSSHT

SEQ ID NO: 4223 - protein, 123 aa, Artificial Sequence; identical to SEQ ID NO: 309
  Description of Artificial Sequence: Synthetic polypeptide

SEQ ID NO: 4224 - protein, 16 aa, Artificial Sequence
  Description of Artificial Sequence: Synthetic peptide
AKDLGYYYGPPYGPDY

SEQ ID NO: 4225 - protein, 108 aa, Artificial Sequence; identical to SEQ ID NO: 310
  Description of Artificial Sequence: Synthetic polypeptide

SEQ ID NO: 4226 - protein, 10 aa, Artificial Sequence
  Description of Artificial Sequence: Synthetic peptide
LQYDNFSMYT

SEQ ID NO: 4227 - protein, 121 aa, Artificial Sequence; identical to SEQ ID NO: 255
  Description of Artificial Sequence: Synthetic polypeptide

SEQ ID NO: 4228 - protein, 14 aa, Artificial Sequence
  Description of Artificial Sequence: Synthetic peptide
AKGGPYGDHVRSDY

SEQ ID NO: 4229 - protein, 107 aa, Artificial Sequence; identical to SEQ ID NO: 256
  Description of Artificial Sequence: Synthetic polypeptide

SEQ ID NO: 4230 - protein, 9 aa, Artificial Sequence
  Description of Artificial Sequence: Synthetic peptide
QQFHNLPLT

SEQ ID NO: 4231 - protein, 122 aa, Artificial Sequence
  Description of Artificial Sequence: Synthetic polypeptide
QLQLQESGPGLVKPSETLSLTCAVSGGSISNSPFYWGWIRQPPGKGLECIGSIYYSGSTYYNPSLKSRVTISVDTSKKQFSLKLSSVTAADTAVYYCARHFADGSGRVVDSWGQGILVTVSS

SEQ ID NO: 4232 - protein, 14 aa, Artificial Sequence
  Description of Artificial Sequence: Synthetic peptide
ARHFADGSGRVVDS

SEQ ID NO: 4233 - protein, 108 aa, Artificial Sequence
  Description of Artificial Sequence: Synthetic polypeptide
EIVLTQSPATLSLSPGERATLSCRASQSVSSYLAWYQQKPGQAPSLLIYDVSNRATGIPARFSGSGSGTDFTLTISSLEPEDFAVYYCQQRINWPLYTFGQGTKLEIK

SEQ ID NO: 4234 - protein, 10 aa, Artificial Sequence
  Description of Artificial Sequence: Synthetic peptide
QQRINWPLYT

SEQ ID NO: 4235 - protein, 126 aa, Artificial Sequence
  Description of Artificial Sequence: Synthetic polypeptide
QVQLVQSGAEVKKPGSSVKVSCKASGGDFTTYAITWVRQAPGQGLELMGGLIPLFGTANSAQKFQGRVTITADESTSTAYLELSSLSSEDTAVYYCARGRWRAAALSTLRTAFDYWGQGTLLTVSS

SEQ ID NO: 4236 - protein, 19 aa, Artificial Sequence
  Description of Artificial Sequence: Synthetic peptide
ARGRWRAAALSTLRTAFDY

SEQ ID NO: 4237 - protein, 108 aa, Artificial Sequence
  Description of Artificial Sequence: Synthetic polypeptide
EIVMTQSPATLSVSPGERVTLSCRASQSVSSNLAWYQQKPGQAPRLLIYGASTRATGIPARFSGSGSGTEFTLTISSLQSEDFAIYYCQQYNKWPMYTFGQGTKLEIK

SEQ ID NO: 4238 - protein, 10 aa, Artificial Sequence
  Description of Artificial Sequence: Synthetic peptide
QQYNKWPMYT

SEQ ID NO: 4239 - protein, 122 aa, Artificial Sequence
  Description of Artificial Sequence: Synthetic polypeptide
EVQLVESGGGLVQPGGSLRLSCSASGFTFTTYAMHWVRQAPGKGLEYVSTISSNGDSTYYADSVKGRFTISRDNSKNTLHLQMSSLRTEDTAVYYCVKDELGGYFGNYFDYWGQGTLVTVSS

SEQ ID NO: 4240 - protein, 15 aa, Artificial Sequence
  Description of Artificial Sequence: Synthetic peptide
VKDELGGYFGNYFDY

SEQ ID NO: 4241 - protein, 110 aa, Artificial Sequence; identical to SEQ ID NO: 4125
  Description of Artificial Sequence: Synthetic polypeptide

SEQ ID NO: 4242 - protein, 12 aa, Artificial Sequence
  Description of Artificial Sequence: Synthetic peptide
QQSYSAPPGPYT

SEQ ID NO: 4243 - protein, 120 aa, Artificial Sequence; identical to SEQ ID NO: 261
  Description of Artificial Sequence: Synthetic polypeptide

SEQ ID NO: 4244 - protein, 11 aa, Artificial Sequence
  Description of Artificial Sequence: Synthetic peptide
TRWDGWSQHDY

SEQ ID NO: 4245 - protein, 111 aa, Artificial Sequence; identical to SEQ ID NO: 262
  Description of Artificial Sequence: Synthetic polypeptide

SEQ ID NO: 4246 - protein, 9 aa, Artificial Sequence
  Description of Artificial Sequence: Synthetic peptide
MQVLQIPYT

SEQ ID NO: 4247 - protein, 126 aa, Artificial Sequence
  Description of Artificial Sequence: Synthetic polypeptide
QVQLVQSGAEVKKPGSSVKVSCKASGGSFSTYAISWVRQAPGQGLEWMGGIIPAFGTANYAQKFQGRVTIAADESTSTAFMELSSLRSEDTAVYYCARGGCSSNSCYAAQYGMDVWGQGTTVTVSS

SEQ ID NO: 4248 - protein, 19 aa, Artificial Sequence
  Description of Artificial Sequence: Synthetic peptide
ARGGCSSNSCYAAQYGMDV

SEQ ID NO: 4249 - protein, 107 aa, Artificial Sequence
  Description of Artificial Sequence: Synthetic polypeptide
DIQMTQSPSSLSASIGNRVTITCQASQDINNYLNWYQQKPGKAPKLLIYDASNLETGVPSRFSGSGSGTDFTFTISSLQPEDIATYYCQQYDNPALTFGGGTKVEIK

SEQ ID NO: 4250 - protein, 9 aa, Artificial Sequence
  Description of Artificial Sequence: Synthetic peptide
QQYDNPALT

SEQ ID NO: 4251 - protein, 120 aa, Artificial Sequence
  Description of Artificial Sequence: Synthetic polypeptide
QVQLVQSGAEVKKPGASVKVSCKVSGYNLTELSMYWVRQAPGKGLEWMGGFDPEDGGPIHAQKFQGRVTMTEDPSTDTAYMELRSLRSEDTALYYCATGGLFMIRGLEIWGRGTLVSVSS

SEQ ID NO: 4252 - protein, 13 aa, Artificial Sequence
  Description of Artificial Sequence: Synthetic peptide
ATGGLFMIRGLEI

SEQ ID NO: 4253 - protein, 109 aa, Artificial Sequence; identical to SEQ ID NO: 298
  Description of Artificial Sequence: Synthetic polypeptide

SEQ ID NO: 4254 - protein, 10 aa, Artificial Sequence
  Description of Artificial Sequence: Synthetic peptide
QQYGNSPRLS

SEQ ID NO: 4255 - protein, 118 aa, Artificial Sequence
  Description of Artificial Sequence: Synthetic polypeptide
EVQLVESGGGLIQPGGSLRLSCAASGLIVSSNYMNWVRQAPGKGLEWVSLLYSGGSTYYADSVKGRFTISRDNSKNTLYLQMNSLRPEDTAVYYCARDLSVVGAFDIWGQGTVVTVSS

SEQ ID NO: 4256 - protein, 12 aa, Artificial Sequence
  Description of Artificial Sequence: Synthetic peptide
ARDLSVVGAFDI

SEQ ID NO: 4257 - protein, 109 aa, Artificial Sequence; identical to SEQ ID NO: 248
  Description of Artificial Sequence: Synthetic polypeptide

SEQ ID NO: 4258 - protein, 10 aa, Artificial Sequence
  Description of Artificial Sequence: Synthetic peptide
QQYGTSPRVT

SEQ ID NO: 4259 - protein, 118 aa, Artificial Sequence
  Description of Artificial Sequence: Synthetic polypeptide
EVQLVESGGGLIQPGGSLRLSCAASGLTVSNNYVSWVRQGPGKGLEWVSVIYSDAKTYYADSVKGRFSISRDNSKNTVYLQMNSLRAEDTAVYHCARLPPHRGDRDYWGQGTLVTVSS

SEQ ID NO: 4260 - protein, 12 aa, Artificial Sequence
  Description of Artificial Sequence: Synthetic peptide
ARLPPHRGDRDY

SEQ ID NO: 4261 - protein, 107 aa, Artificial Sequence
  Description of Artificial Sequence: Synthetic polypeptide
DIQMTQSPSSLSASVGDRVTITCRASQGISDYLAWYQQKPGKVPNLLIYAASTLQSGVPSRFSGSGSGTDFTLTISGLQPEDVATYYCQKYDSTPLTFGGGTKVEIK

SEQ ID NO: 4262 - protein, 9 aa, Artificial Sequence
  Description of Artificial Sequence: Synthetic peptide
QKYDSTPLT

SEQ ID NO: 4263 - protein, 122 aa, Artificial Sequence
  Description of Artificial Sequence: Synthetic polypeptide
QVQLQESGPGLVKPSETLSLTCSVSGGSISSYYWSWIRQPPGKGLEWIGNIFYSGSTNYNPSLKSRVTISIDTSKDQFSLKLSSVTAADTAVYYCATYYYDSTGYSYGMDVWGQGTTVTVSS

SEQ ID NO: 4264 - protein, 16 aa, Artificial Sequence
  Description of Artificial Sequence: Synthetic peptide
ATYYYDSTGYSYGMDV

SEQ ID NO: 4265 - protein, 107 aa, Artificial Sequence
  Description of Artificial Sequence: Synthetic polypeptide
DIQMTQSPSSLSASIGDRVTITCRASQSIGSYLHWYQQRPGKAPKLLIYAVSNLQSGVPSRFSGRGSGTDFTLTVSSLQPEDFATYYCQQTYSSPQTFGQGTKVDIK

SEQ ID NO: 4266 - protein, 9 aa, Artificial Sequence
  Description of Artificial Sequence: Synthetic peptide
QQTYSSPQT

SEQ ID NO: 4267 - protein, 125 aa, Artificial Sequence
  Description of Artificial Sequence: Synthetic polypeptide
QVQLVESGGGVVQPGRSLRLSCAASGFMFSSYGMHWVRQAPGKGLEWVAVIYYDGSNKYYADSVKGRFTISRDNSKNTLYLQMNSLRAEDTAVYYCAKDGLPLRGSGSPYGMDVWGQGTMVTVSS

SEQ ID NO: 4268 - protein, 18 aa, Artificial Sequence
  Description of Artificial Sequence: Synthetic peptide
AKDGLPLRGSGSPYGMDV

SEQ ID NO: 4269 - protein, 107 aa, Artificial Sequence
  Description of Artificial Sequence: Synthetic polypeptide
DIQMTQSPSSLSASVGDRVTITCRASQSIITYLNWYQQKPGKAPKLLIYDASSLQSGVPSRFSGSGSGTDFTLTISNLQPEDFATYYCQQSYRTLLTFGGGTKVGIK

SEQ ID NO: 4270 - protein, 9 aa, Artificial Sequence
  Description of Artificial Sequence: Synthetic peptide
QQSYRTLLT

SEQ ID NO: 4271 - protein, 121 aa, Artificial Sequence
  Description of Artificial Sequence: Synthetic polypeptide
QVQLQQWGAGLLKPSETLSLTCAVYGGSFSGYFWSWIRQPPGKGLEWIGEIDHNGVTNYNASLRSRVTISLDTSKNQFSLNLISLTAADTALYFCAIINNSGWRYDAFDIWGQGTMVTVSS

SEQ ID NO: 4272 - protein, 15 aa, Artificial Sequence
  Description of Artificial Sequence: Synthetic peptide
AIINNSGWRYDAFDI

SEQ ID NO: 4273 - protein, 107 aa, Artificial Sequence
  Description of Artificial Sequence: Synthetic polypeptide
DIQMTQSPSSLSASVGDRVTITCRASQSISSFLNWYQQKPGKAPKLLIYAASSLQSGVPSRFSGSGSGTDFTLTIRSLQPEDFATYYCQQSYFTPRAFGHGTKVEMK

SEQ ID NO: 4274 - protein, 9 aa, Artificial Sequence
  Description of Artificial Sequence: Synthetic peptide
QQSYFTPRA

SEQ ID NO: 4275 - protein, 127 aa, Artificial Sequence
  Description of Artificial Sequence: Synthetic polypeptide
QVQLVQSGAEVKKPGSSVKVSCKASGGTFSIYAINWLRQAPGQGLEWMGGIIPISGTANYEQKLQGRLTITADESTSTAYMELSSLRSEDTALYYCARTGRSYYSDNSGYYPYFDYWGQGTLVTVSS

SEQ ID NO: 4276 - protein, 20 aa, Artificial Sequence
  Description of Artificial Sequence: Synthetic peptide
ARTGRSYYSDNSGYYPYFDY

SEQ ID NO: 4277 - protein, 106 aa, Artificial Sequence
  Description of Artificial Sequence: Synthetic polypeptide
DIQMTQSPSSLSASVGDRVTITCRASQSISNYLNWYQQKPGKAPKLLIYAASSLQSGVPSRFSGSGSGTDFTLTISSLQPEDFATYYCQQSYRTITFGGGTKVEIK

SEQ ID NO: 4278 - protein, 8 aa, Artificial Sequence
  Description of Artificial Sequence: Synthetic peptide
QQSYRTIT

SEQ ID NO: 4279 - protein, 129 aa, Artificial Sequence
  Description of Artificial Sequence: Synthetic polypeptide
QVQLVESGGGVVQPGKSLRLSCAASGFTFSVYGLHWVRQAPDKGLEWVATISYDGNNKYYADSVKGRFTIFRDYSKNTLYLQMNSLRPEDTALYYCAKDHSSLSGAFGDLIGSGPVDPWGQGTLVTVSS

SEQ ID NO: 4280 - protein, 22 aa, Artificial Sequence
  Description of Artificial Sequence: Synthetic peptide
AKDHSSLSGAFGDLIGSGPVDP

SEQ ID NO: 4281 - protein, 109 aa, Artificial Sequence
  Description of Artificial Sequence: Synthetic polypeptide
EIVMTQSPATLSVSPGERATLSCRAGQNVSSNLAWYQQKPGQAPRLLIYGASTRAAGIPARFSGSGSGTEFTLTISILQSEDFAVYYCQQYNNRPRGYTFGQGTKLEIK

SEQ ID NO: 4282 - protein, 11 aa, Artificial Sequence
  Description of Artificial Sequence: Synthetic peptide
QQYNNRPRGYT

SEQ ID NO: 4283 - protein, 117 aa, Artificial Sequence
  Description of Artificial Sequence: Synthetic polypeptide
EVQLVESGGGWIQPGGSLRLSCAASGITVSSNYMSWVRQAPGKGLEWVSVIYAGGSTFYADSVKGRFTISRDNSKNTLYLQMNSVRAEDTAVYYCAREIYDDVLDTWGQGTMVTVSS

SEQ ID NO: 4284 - protein, 11 aa, Artificial Sequence
  Description of Artificial Sequence: Synthetic peptide
AREIYDDVLDT

SEQ ID NO: 4285 - protein, 106 aa, Artificial Sequence
  Description of Artificial Sequence: Synthetic polypeptide
DIQLTQSPSSLSASVGDRVTITCRASQGISSYLAWYQQKPGKAPKLLIYAASTLQSGVPSRFSGSGSGTEFTLTISSLQPEDLATYYCQQLNSYLHTFGQGTKLEI

SEQ ID NO: 4286 - protein, 9 aa, Artificial Sequence
  Description of Artificial Sequence: Synthetic peptide
QQLNSYLHT

SEQ ID NO: 4287 - protein, 120 aa, Artificial Sequence
  Description of Artificial Sequence: Synthetic polypeptide
EVQLVESGGGLVQPGGSLRLSCAASGFTFSNYDMHWVRQVTGKGLEWVSVIGTEGDTHYSDSVKGRFTISRENAKKSLYLQMNSLRAGDTAVYYCARDLGSGWVWVMDVWGQGTTVTVSS

SEQ ID NO: 4288 - protein, 14 aa, Artificial Sequence
  Description of Artificial Sequence: Synthetic peptide
ARDLGSGWVWVMDV

SEQ ID NO: 4289 - protein, 108 aa, Artificial Sequence
  Description of Artificial Sequence: Synthetic polypeptide
DIQMTQSPSSLSASVGDRVTITCRASQSISGYLNWYQQKPGKAPKLLIYAASNLQSGVPSRFSGSGSGTDFTLTISSLQPEDFATYYCQQSYSNPPLTFGGGTKVEIK

SEQ ID NO: 4290 - protein, 10 aa, Artificial Sequence
  Description of Artificial Sequence: Synthetic peptide
QQSYSNPPLT

SEQ ID NO: 4291 - protein, 124 aa, Artificial Sequence
  Description of Artificial Sequence: Synthetic polypeptide
QVQLVQSGAEVKKPGSSVKVSCKASGGTFSSYAIIWVRQAPGQGLEWMGGIIPIFGTANYAQNFQGRVTITADESTSTAYMELNSLRSEDTALYYCAAAYYYDSSGILGGDDYWGQGTLVTVSS

SEQ ID NO: 4292 - protein, 17 aa, Artificial Sequence
  Description of Artificial Sequence: Synthetic peptide
AAAYYYDSSGILGGDDY

SEQ ID NO: 4293 - protein, 106 aa, Artificial Sequence
  Description of Artificial Sequence: Synthetic polypeptide
EIVLTQSPATLSLSPGERATLSCRASQSVSNYLAWYQQKPSQAPRLLIFDASHRATGIPARFSGSGSGTDFTLTISSLEPEDFAVYYCQHRYNWLTFGGGTKVEIK

SEQ ID NO: 4294 - protein, 8 aa, Artificial Sequence
  Description of Artificial Sequence: Synthetic peptide
QHRYNWLT

SEQ ID NO: 4295 - protein, 118 aa, Artificial Sequence
  Description of Artificial Sequence: Synthetic polypeptide
QVQLVQSGAEVKKPGSSVKVSCKASGGTFNSYAISWVRQAPGQGLEWMGGIIPIFGTANYAQKFQGRVTITADESTSTAYMELSSLRSEDTAVYFCATTFQWDLLVYWGQGTLVTVSS

SEQ ID NO: 4296 - protein, 11 aa, Artificial Sequence
  Description of Artificial Sequence: Synthetic peptide
ATTFQWDLLVY

SEQ ID NO: 4297 - protein, 108 aa, Artificial Sequence
  Description of Artificial Sequence: Synthetic polypeptide
DIQMTQSPSSLSASVGDRVTITCQASQDISNYLNWYQQKPGKAPKLLIYDASNLEIGVPSRFSGSGSGTDFTFTISSLQPEDIATYYCQQYDHLPIFTFGPGTKVDVK

SEQ ID NO: 4298 - protein, 10 aa, Artificial Sequence
  Description of Artificial Sequence: Synthetic peptide
QQYDHLPIFT

SEQ ID NO: 4299 - protein, 125 aa, Artificial Sequence; identical to SEQ ID NO: 293
  Description of Artificial Sequence: Synthetic polypeptide

SEQ ID NO: 4300 - protein, 16 aa, Artificial Sequence
  Description of Artificial Sequence: Synthetic peptide
TKDIAAGIPALNWFDS

SEQ ID NO: 4301 - protein, 109 aa, Artificial Sequence; identical to SEQ ID NO: 294
  Description of Artificial Sequence: Synthetic polypeptide

SEQ ID NO: 4302 - protein, 11 aa, Artificial Sequence
  Description of Artificial Sequence: Synthetic peptide
QQHTNWPPRIT

SEQ ID NO: 4303 - protein, 121 aa, Artificial Sequence
  Description of Artificial Sequence: Synthetic polypeptide
QVQLVESGGGVVQPGRSLRLSCAASGFTFSNYGIHWVRQAPGKGLEWVAVISYDGSDKYYADSVKGRFTISRDNSKNTLYLQMNSLRAEDTAVYYCAKGGPYGDHVRSDYWGQGTLVTVSS

SEQ ID NO: 4304 - protein, 14 aa, Artificial Sequence
  Description of Artificial Sequence: Synthetic peptide
AKGGPYGDHVRSDY

SEQ ID NO: 4305 - protein, 104 aa, Artificial Sequence
  Description of Artificial Sequence: Synthetic polypeptide
  MOD_RES (87)..(87): Any amino acid
DIQMTQSPSSLSASVGDRVTITCQASQDISNYLNWYQQKPGKAPKLLIYDASYLETGVPSRFSGSGSGTHFTFTISSLQPEDIATYXSQQYEILPLTFGQGTKM

SEQ ID NO: 4306 - protein, 9 aa, Artificial Sequence
  Description of Artificial Sequence: Synthetic peptide
QQYEILPLT

SEQ ID NO: 4307 - protein, 124 aa, Artificial Sequence
  Description of Artificial Sequence: Synthetic polypeptide
EVQLVESGGGLVQPGGSLRLSCAASGFTFSSYDMHWVRQATGKRLEWVSLIGTAGDTYYPASVKGRFTISRENAKNSLYLQMNSLRAGDTAVYYCARVSYYYGSSGYSSYFDLWGRGTLVTVSS

SEQ ID NO: 4308 - protein, 18 aa, Artificial Sequence
  Description of Artificial Sequence: Synthetic peptide
ARVSYYYGSSGYSSYFDL

SEQ ID NO: 4309 - protein, 109 aa, Artificial Sequence
  Description of Artificial Sequence: Synthetic polypeptide
DIQMTQSPSSLSASVGDRVTITCRASQRISSYLNWYQQKPGKAPKLLIYAASSLQSGVPSRFSGSGSGTDFTLTISSLQPEDFATYYCQQSYSNPPEDTFGQGTKLEIK

SEQ ID NO: 4310 - protein, 11 aa, Artificial Sequence
  Description of Artificial Sequence: Synthetic peptide
QQSYSNPPEDT

SEQ ID NO: 4311 - protein, 121 aa, Artificial Sequence
  Description of Artificial Sequence: Synthetic polypeptide
QVQLVESGGGLVKPGGSLRLSCTASGFTFSDYYMTWLRQAPGKGLEWVSYISSTSPYTSYADSVKGRFTISRDNARNSVYLQMNSLRAEDTAIYYCARVPPPQRLHPFDVWGQGTMVTVSS

SEQ ID NO: 4312 - protein, 14 aa, Artificial Sequence
  Description of Artificial Sequence: Synthetic peptide
ARVPPPQRLHPFDV

SEQ ID NO: 4313 - protein, 106 aa, Artificial Sequence
  Description of Artificial Sequence: Synthetic polypeptide
DIQMTQSPSTLSASVGDRVTITCRASQSISSWLAWYQQKPGKAPKLLIYQASSLESGVPSRFSGSGSGTDFTLTISSLQPDDFATYYCQQYFRYSWTFGQGTKVEI

SEQ ID NO: 4314 - protein, 9 aa, Artificial Sequence
  Description of Artificial Sequence: Synthetic peptide
QQYFRYSWT

SEQ ID NO: 4315 - protein, 121 aa, Artificial Sequence; identical to SEQ ID NO: 255
  Description of Artificial Sequence: Synthetic polypeptide

SEQ ID NO: 4316 - protein, 14 aa, Artificial Sequence
  Description of Artificial Sequence: Synthetic peptide
AKGGPYGDHVRSDY

SEQ ID NO: 4317 - protein, 107 aa, Artificial Sequence; identical to SEQ ID NO: 256
  Description of Artificial Sequence: Synthetic polypeptide

SEQ ID NO: 4318 - protein, 9 aa, Artificial Sequence
  Description of Artificial Sequence: Synthetic peptide
QQFHNLPLT

SEQ ID NO: 4319 - protein, 128 aa, Artificial Sequence
  Description of Artificial Sequence: Synthetic polypeptide
EVQLVESGGGLVKPGRSLRLSCTASGTASGFIFGDYAVNWFRQAPGKGLEWVGFIRSKPYGGTTQYAASVRGRFTISRDDSKSTAYLQMNSLKIEDTAVYYCTQPPGYCSGGRCYFASWGQGTLVTVS

SEQ ID NO: 4320 - protein, 16 aa, Artificial Sequence
  Description of Artificial Sequence: Synthetic peptide
TQPPGYCSGGRCYFAS

SEQ ID NO: 4321 - protein, 106 aa, Artificial Sequence
  Description of Artificial Sequence: Synthetic polypeptide
EIVMTQSPATLSVSPGERATLSCRASQSVSSNLAWYQQKPGQAPRLLIYDSSTRATGIPARFSGSGSGTDFILTISGLQSEDFAVYYCQQYDNWHSFGQGTKVEIK

SEQ ID NO: 4322 - protein, 8 aa, Artificial Sequence
  Description of Artificial Sequence: Synthetic peptide
QQYDNWHS

SEQ ID NO: 4323 - protein, 118 aa, Artificial Sequence
  Description of Artificial Sequence: Synthetic polypeptide
EVQLVESGGGLIQPGGSLRLSCAASGLTVSSNYMSWVRQAPGKGLEWVSVIYSGGSTFYADSVKDRFTISRDNEKNTLYLQMNSLRAEDTAVYYCARDLEVAGGFDCWGQGTLVTVSS

SEQ ID NO: 4324 - protein, 12 aa, Artificial Sequence
  Description of Artificial Sequence: Synthetic peptide
ARDLEVAGGFDC

SEQ ID NO: 4325 - protein, 108 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNDYPSITFGQGTRLEIK

SEQ ID NO: 4326 - protein, 10 aa, Artificial Sequence
  Description of Artificial Sequence: Synthetic peptide
QQLNDYPSIT

SEQ ID NO: 4327 - protein, 120 aa, Artificial Sequence
  Description of Artificial Sequence: Synthetic polypeptide
EVQLVQSGAEVKKPGESLKISCEGSGYRFTTYWIAWVRQMPGKGLEWMGIIYCGDSDTRYNPSFQGEVSISVDKSISTAYLQWSSLKASDTAMYYCARSRSGIHDAFDMWGQGTMVTVSS

SEQ ID NO: 4328 - protein, 13 aa, Artificial Sequence
  Description of Artificial Sequence: Synthetic peptide
ARSRSGIHDAFDM

SEQ ID NO: 4329 - protein, 106 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTITSLQPEDIATYYCQQYDNLPLFGPGTKVDIK

SEQ ID NO: 4330 - protein, 8 aa, Artificial Sequence
  Description of Artificial Sequence: Synthetic peptide
QQYDNLPL

SEQ ID NO: 4331 - protein, 119 aa, Artificial Sequence
  Description of Artificial Sequence: Synthetic polypeptide
EVQLVESGGGLVQPGGSLRLSCAASGFTFSSYDMHWVRQTTGKRLEWVSVIGTAGDTYYADSVKGRFTISRENAKSSLYLQMNSLRAGDTAVYYCARDIGSIWPQFDPWGQGTLVIVSS

SEQ ID NO: 4332 - protein, 13 aa, Artificial Sequence
  Description of Artificial Sequence: Synthetic peptide
ARDIGSIWPQFDP

SEQ ID NO: 4333 - protein, 108 aa, Artificial Sequence
  Description of Artificial Sequence: Synthetic polypeptide
DIQMTQSPSSLSASVGDRVTITCRASQYISSYLNWYQQRSGKAPKLLIYAASTLQSGVPSRFSGSGSGTDFTLTISSLQAEDFATYYCQQSYTTVALTFGGGTKVEIK

SEQ ID NO: 4334 - protein, 10 aa, Artificial Sequence
  Description of Artificial Sequence: Synthetic peptide
QQSYTTVALT

SEQ ID NO: 4335 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSAISGSGDSTYYADSVKGRFTISRDSSKNTLYLQMNSLRAEDTAVYYCVMRYYDILTGPWTPHWGQGTLVTVSS

SEQ ID NO: 4336 - protein, 15 aa, Artificial Sequence
  Description of Artificial Sequence: Synthetic peptide
VMRYYDILTGPWTPH

SEQ ID NO: 4337 - protein, 108 aa, Artificial Sequence
  Description of Artificial Sequence: Synthetic polypeptide
DIQMTQSPSSLSASVGDRVTITCQASQDISNYLNWYQQKPGKAPELLIYDASNLEIGVPSRFSGSGSGTDFTFTISSLQPEDIATYYCQQYDNLPPLTFGGGTKVEIK

SEQ ID NO: 4338 - protein, 10 aa, Artificial Sequence
  Description of Artificial Sequence: Synthetic peptide
QQYDNLPPLT

SEQ ID NO: 4339 - protein, 122 aa, Artificial Sequence
  Description of Artificial Sequence: Synthetic polypeptide
QVQLQESGPGLVKPSETLSLTCTVSGGSISSYYWSWIRQPPGKGLEWIGYIFYSGSTNYNPSLRSRVTISVDTSKNQFSLKLSSLTAADTAVYYCARDLGRSSGWPDAFDIWGRGTMVTVSS

SEQ ID NO: 4340 - protein, 16 aa, Artificial Sequence
  Description of Artificial Sequence: Synthetic peptide
ARDLGRSSGWPDAFDI

SEQ ID NO: 4341 - protein, 107 aa, Artificial Sequence
  Description of Artificial Sequence: Synthetic polypeptide
EIVLTQSPATLSLSPGERATLSCRASQSVSSYLDWYQQKAGQPPRLLIYDVSNRATGIPARFSGSGSGTDFTLTISSLEPEDFAVYSCQQRSNWPGTFGQGTKLEIK

SEQ ID NO: 4342 - protein, 9 aa, Artificial Sequence
  Description of Artificial Sequence: Synthetic peptide
QQRSNWPGT

SEQ ID NO: 4343 - protein, 120 aa, Artificial Sequence; identical to SEQ ID NO: 307
  Description of Artificial Sequence: Synthetic polypeptide

SEQ ID NO: 4344 - protein, 13 aa, Artificial Sequence
  Description of Artificial Sequence: Synthetic peptide
AKSWWLSENWFDP

SEQ ID NO: 4345 - protein, 107 aa, Artificial Sequence; identical to SEQ ID NO: 308
  Description of Artificial Sequence: Synthetic polypeptide

SEQ ID NO: 4346 - protein, 9 aa, Artificial Sequence
  Description of Artificial Sequence: Synthetic peptide
QQYNNWPLT

SEQ ID NO: 4347 - protein, 124 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDTAKNSLYLQMNSLRDEDTAVYYCARDTGFWSGNFPGLFDYWGQGTLVTVSS

SEQ ID NO: 4348 - protein, 17 aa, Artificial Sequence
  Description of Artificial Sequence: Synthetic peptide
ARDTGFWSGNFPGLFDY

SEQ ID NO: 4349 - protein, 108 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQHYDTLPPVTFGQGTRLDIK

SEQ ID NO: 4350 - protein, 10 aa, Artificial Sequence
  Description of Artificial Sequence: Synthetic peptide
QHYDTLPPVT

SEQ ID NO: 4351 - protein, 123 aa, Artificial Sequence; identical to SEQ ID NO: 253
  Description of Artificial Sequence: Synthetic polypeptide

SEQ ID NO: 4352 - protein, 16 aa, Artificial Sequence
  Description of Artificial Sequence: Synthetic peptide
ARDEAFLPSAIFVGDY

SEQ ID NO: 4353 - protein, 109 aa, Artificial Sequence; identical to SEQ ID NO: 254
  Description of Artificial Sequence: Synthetic polypeptide

SEQ ID NO: 4354 - protein, 11 aa, Artificial Sequence
  Description of Artificial Sequence: Synthetic peptide
LQHSTYPHTWT

SEQ ID NO: 4355 - protein, 122 aa, Artificial Sequence; identical to SEQ ID NO: 257
  Description of Artificial Sequence: Synthetic polypeptide

SEQ ID NO: 4356 - protein, 16 aa, Artificial Sequence
  Description of Artificial Sequence: Synthetic peptide
ATYYFDNSGYSYGLDV

SEQ ID NO: 4357 - protein, 107 aa, Artificial Sequence; identical to SEQ ID NO: 258
  Description of Artificial Sequence: Synthetic polypeptide

SEQ ID NO: 4358 - protein, 9 aa, Artificial Sequence
  Description of Artificial Sequence: Synthetic peptide
QQSYSLPQT

SEQ ID NO: 4359 - protein, 123 aa, Artificial Sequence
  Description of Artificial Sequence: Synthetic polypeptide
QVQLVESGGGVVQPGRSLRLSCAASGFTFSSYAMHWVRQAPGKGLEWVAVILYDGSNKYYADSVKGRFTISRDNSKNTLYLQMNSLRAEDTAVYYCARDQDLDTAMVTLFDYWGQGTLVTVSS

SEQ ID NO: 4360 - protein, 16 aa, Artificial Sequence
  Description of Artificial Sequence: Synthetic peptide
ARDQDLDTAMVTLFDY

SEQ ID NO: 4361 - protein, 108 aa, Artificial Sequence
  Description of Artificial Sequence: Synthetic polypeptide
DIQMTQSPSSLSASVRDRVTITCRASQSISSYLNWYQQKPGKAPKLLIYAASSLQSGVPSRFSGSGSGTDFTLTISSLQPEDLATYYCQQSYSTPPWTFGQGTKVEIK

SEQ ID NO: 4362 - protein, 10 aa, Artificial Sequence
  Description of Artificial Sequence: Synthetic peptide
QQSYSTPPWT

SEQ ID NO: 4363 - protein, 123 aa, Artificial Sequence
  Description of Artificial Sequence: Synthetic polypeptide
QVQLQQWGAGLLKPSETLSLTCAVSGGSLSGFYWTWIRQPPGKGLEWIGETNHFGSTDYKASLKSRVTISVGMSRNQFSLKVTSLTAADTAVYYCARKPLLYSDFSPGAFDIWGQGTMIVVSS

SEQ ID NO: 4364 - protein, 17 aa, Artificial Sequence
  Description of Artificial Sequence: Synthetic peptide
ARKPLLYSDFSPGAFDI

SEQ ID NO: 4365 - protein, 107 aa, Artificial Sequence
  Description of Artificial Sequence: Synthetic polypeptide
EIVLTQSPGTLSLSPGERATLSCRASQTLTANYLAWYQQKPGQAPRLLIYGASKRAAGIPDRFSGSGSGTDFTLSITRLEPEDFAVYYCQQYHTTPRTFGGGTKVEI

SEQ ID NO: 4366 - protein, 9 aa, Artificial Sequence
  Description of Artificial Sequence: Synthetic peptide
QQYHTTPRT

SEQ ID NO: 4367 - protein, 119 aa, Artificial Sequence
  Description of Artificial Sequence: Synthetic polypeptide
EVQLVESGGGLIQPGGSLRLSCAASGLTVSSNYMSWVRQAPGKGLEWVSVLYSGGSSFYADSVKGRFTISRDNSKNTLYLQMNSLRAEDTAVYYCARESGDTTMAFDYWGQGTLVTVSS

SEQ ID NO: 4368 - protein, 13 aa, Artificial Sequence
  Description of Artificial Sequence: Synthetic peptide
ARESGDTTMAFDY

SEQ ID NO: 4369 - protein, 107 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNSDSYTFGQGTKLEIK

SEQ ID NO: 4370 - protein, 9 aa, Artificial Sequence
  Description of Artificial Sequence: Synthetic peptide
QQLNSDSYT

SEQ ID NO: 4371 - protein, 126 aa, Artificial Sequence
  Description of Artificial Sequence: Synthetic polypeptide
QVQLVESGGGVVQPGRSLRLSCAASGFTFSTYGMHWVRQAPGKGLEWVAVISYDGSNKYYADSVKGRFTISRDNSKNTLYLQMNSLRAEDTAVYYCAKGGLYDSSGYYPHYGMDVWGQGTTVTVSS

SEQ ID NO: 4372 - protein, 19 aa, Artificial Sequence
  Description of Artificial Sequence: Synthetic peptide
AKGGLYDSSGYYPHYGMDV

SEQ ID NO: 4373 - protein, 107 aa, Artificial Sequence
  Description of Artificial Sequence: Synthetic polypeptide
DIQMTQSPSSLSASVGDRVTITCQASQDINNYLNWYQQKPGKAPKVLIYDASNLETGVPSRFSGSGSGTDFTFTISSLQPEDFATYYCQQYDNLPLAFGGGTKVEIK

SEQ ID NO: 4374 - protein, 9 aa, Artificial Sequence
  Description of Artificial Sequence: Synthetic peptide
QQYDNLPLA

SEQ ID NO: 4375 - protein, 116 aa, Artificial Sequence
  Description of Artificial Sequence: Synthetic polypeptide
EVQLVESGGGLIQPGGSLRLSCAASGVTVSRNYMSWVRQAPGKGLEWVSVIYSGGSTYYADSVKGRFTISRDNSKNTLYLQMNSLRAEDTAVYYCARDLSAAFDIWGQGTMVTVSS

SEQ ID NO: 4376 - protein, 10 aa, Artificial Sequence
  Description of Artificial Sequence: Synthetic peptide
ARDLSAAFDI

SEQ ID NO: 4377 - protein, 107 aa, Artificial Sequence; identical to SEQ ID NO: 3605
  Description of Artificial Sequence: Synthetic polypeptide

SEQ ID NO: 4378 - protein, 9 aa, Artificial Sequence
  Description of Artificial Sequence: Synthetic peptide
QQLNSYPPA

SEQ ID NO: 4379 - protein, 125 aa, Artificial Sequence
  Description of Artificial Sequence: Synthetic polypeptide
QVQLVESGGGVVQPGRSLRLSCAASGFTFSNFGMHWVRQAPGKGLEWVAVIWYDGSNKYYADSVKGRFTISRDNSKNTLYLQMNSLRAEDTAVYYCARGVNPDDILTGVDAFDIWGQGTMVTVSS

SEQ ID NO: 4380 - protein, 18 aa, Artificial Sequence
  Description of Artificial Sequence: Synthetic peptide
ARGVNPDDILTGVDAFDI

SEQ ID NO: 4381 - protein, 107 aa, Artificial Sequence
  Description of Artificial Sequence: Synthetic polypeptide
DIQMTQSPSTLSASVGDRVTITCRASQSMSSWLAWYQQKPGNAPKLLIYKASSLESGVPSRFSGSGSGTEFTLTISSLQPDDFATYYCQQHNSSPLTFGGGTKVEIK

SEQ ID NO: 4382 - protein, 9 aa, Artificial Sequence
  Description of Artificial Sequence: Synthetic peptide
QQHNSSPLT

SEQ ID NO: 4383 - protein, 132 aa, Artificial Sequence
  Description of Artificial Sequence: Synthetic polypeptide
QVQLVQSGAEVVRPGASVKVSCKASGYTFTTHYMHWVRQAPGQGLEWMGIINPSVGSTSYAQKFQGRVTMTRDTSTSTVYMELSSLISEDTAMYYCARGPRSPSDWCSGGSCYDDQNWFDPWGQGTLVTVSS

SEQ ID NO: 4384 - protein, 25 aa, Artificial Sequence
  Description of Artificial Sequence: Synthetic peptide
ARGPRSPSDWCSGGSCYDDQNWFDP

SEQ ID NO: 4385 - protein, 107 aa, Artificial Sequence
  Description of Artificial Sequence: Synthetic polypeptide
DIQMTQSPSSLSASVGDRVTITCRASQSISSYLNWYQQKPGKAPKLLIYSASSLQSGVPSRFSGSGSGTDFTLTISSLQPEDFATYYCQQSYSTLITFGQGTRLEIK

SEQ ID NO: 4386 - protein, 9 aa, Artificial Sequence
  Description of Artificial Sequence: Synthetic peptide
QQSYSTLIT

SEQ ID NO: 4387 - protein, 124 aa, Artificial Sequence
  Description of Artificial Sequence: Synthetic polypeptide
QVQLVQSGAEVMKPGASVKVSCKASGYTFTSYYMHWVRQAPGQGLEWMGIINPTAGSTSYAQKFQGRVTMTRDTSTSTVYMELSSLRSEDTAVYYCARDFELWFGELRGWFDPWGQGTLVTVSS

SEQ ID NO: 4388 - protein, 17 aa, Artificial Sequence
  Description of Artificial Sequence: Synthetic peptide
ARDFELWFGELRGWFDP

SEQ ID NO: 4389 - protein, 108 aa, Artificial Sequence
  Description of Artificial Sequence: Synthetic polypeptide
EIVMTQSPATLSVSPGERATLSCRASQSVSSNLAWYQQKPGQAPTLLIYGASTRATGIPARFSGSGSGTEFTLTISSLQSEDFAVYYCQQYNNWPPITFGQGTRLEIK

SEQ ID NO: 4390 - protein, 10 aa, Artificial Sequence
  Description of Artificial Sequence: Synthetic peptide
QQYNNWPPIT

SEQ ID NO: 4391 - protein, 125 aa, Artificial Sequence
  Description of Artificial Sequence: Synthetic polypeptide
EVQLVESGGGLVQPGGSLRLSCAASGFTFSGYSMNWVRQAPGKGPEWVSYISRSSSTIYYADSVKGRFTISRDNAKNSLYLQMNSLRDEDTAVYYCAREGARVGATYDTYYFDYWGQGTLVTVSS

SEQ ID NO: 4392 - protein, 18 aa, Artificial Sequence
  Description of Artificial Sequence: Synthetic peptide
AREGARVGATYDTYYFDY

SEQ ID NO: 4393 - protein, 109 aa, Artificial Sequence
  Description of Artificial Sequence: Synthetic polypeptide
EIVLTQSPATLSLSPGERATLSCRASQSFSSYLAWYQQKPGQAPRLLIYDASNRATGIPARFSGSGSGTDFTLTISSLEPEDFAVYYCQQRNNWPPEWTFGQGTKVEIK

SEQ ID NO: 4394 - protein, 11 aa, Artificial Sequence
  Description of Artificial Sequence: Synthetic peptide
QQRNNWPPEWT

SEQ ID NO: 4395 - protein, 124 aa, Artificial Sequence
  Description of Artificial Sequence: Synthetic polypeptide
EVQLVESGGGLIQPGGSLRLSCAASGFTVSSNYMSWVRQAPGKGLEWVSLIYSGGSTYYADSVKGRFTISRDNSKNTLYLQMNSLRAEDTAVYYCARTDIVVVPAARGFYFDYWGQGTLVTVSS

SEQ ID NO: 4396 - protein, 18 aa, Artificial Sequence
  Description of Artificial Sequence: Synthetic peptide
ARTDIVVVPAARGFYFDY

SEQ ID NO: 4397 - protein, 106 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYGTFGQGTKVEIK

SEQ ID NO: 4398 - protein, 8 aa, Artificial Sequence
  Description of Artificial Sequence: Synthetic peptide
QQYNSYGT

SEQ ID NO: 4399 - protein, 117 aa, Artificial Sequence
  Description of Artificial Sequence: Synthetic polypeptide
EVQLVESGGGLIQPGGSLRLSCAASGFIVSSNYMSWVRQAPGKGLEWVSVIYSGGSTYYADSVKGRFTISRDNSKNTLYLQMNSLRVEDTAVYYCARDYGDYYFDYWGQGTLVTVSS

SEQ ID NO: 4400 - protein, 11 aa, Artificial Sequence
  Description of Artificial Sequence: Synthetic peptide
ARDYGDYYFDY

SEQ ID NO: 4401 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPRTFGQGTKVEIK

SEQ ID NO: 4402 - protein, 9 aa, Artificial Sequence
  Description of Artificial Sequence: Synthetic peptide
QQYGSSPRT

SEQ ID NO: 4403 - protein, 120 aa, Artificial Sequence
  Description of Artificial Sequence: Synthetic polypeptide
EVQLVQSGAEVKKPGESLKISCKGSGYSFTSYWIGWVRQMPGKDLEWMGIIYPGDSDTRYSPSFQGQVTISADKSISTAYLQWSSLKASDTAMYYCALTTVTTGRWFDPWGQGTLVTVSS

SEQ ID NO: 4404 - protein, 13 aa, Artificial Sequence
  Description of Artificial Sequence: Synthetic peptide
ALTTVTTGRWFDP

SEQ ID NO: 4405 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYQVSNRDSGVPDRFSGSGSGTDFTLKISRVEAEDVGVYYCMQGTHWLWTFGQGTKVEIK

SEQ ID NO: 4406 - protein, 9 aa, Artificial Sequence
  Description of Artificial Sequence: Synthetic peptide
MQGTHWLWT

SEQ ID NO: 4407 - protein, 125 aa, Artificial Sequence; identical to SEQ ID NO: 4379
  Description of Artificial Sequence: Synthetic polypeptide

SEQ ID NO: 4408 - protein, 18 aa, Artificial Sequence
  Description of Artificial Sequence: Synthetic peptide
ARGVNPDDILTGVDAFDI

SEQ ID NO: 4409 - protein, 107 aa, Artificial Sequence; identical to SEQ ID NO: 4381
  Description of Artificial Sequence: Synthetic polypeptide

SEQ ID NO: 4410 - protein, 9 aa, Artificial Sequence
  Description of Artificial Sequence: Synthetic peptide
QQHNSSPLT

SEQ ID NO: 4411 - protein, 123 aa, Artificial Sequence
  Description of Artificial Sequence: Synthetic polypeptide
EVQLVQSGAEVKKPGESLRISCKGSGYSFTSYYISWVRQMPGKGLEWMGRIDPSDSYTNYSPSFQGHVTISADKSISAAYLQWSSLKASDTAMYYCARHRHPGITMIVALDYWGQGTLVTVSS

SEQ ID NO: 4412 - protein, 16 aa, Artificial Sequence
  Description of Artificial Sequence: Synthetic peptide
ARHRHPGITMIVALDY

SEQ ID NO: 4413 - protein, 105 aa, Artificial Sequence
  Description of Artificial Sequence: Synthetic polypeptide
DIQMTQSPSSLSASVGDRVTITCQASQDISNYLNWYQQKPGKAPKLLIYDASYLETGVPSRFTGSASGTDFTFTISSLQPEDIATYYCQQYDNVPLFGPGTKVDI

SEQ ID NO: 4414 - protein, 8 aa, Artificial Sequence
  Description of Artificial Sequence: Synthetic peptide
QQYDNVPL

SEQ ID NO: 4415 - protein, 117 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDWGEYYFDYWGQGTLVTVSS

SEQ ID NO: 4416 - protein, 11 aa, Artificial Sequence
  Description of Artificial Sequence: Synthetic peptide
ARDWGEYYFDY

SEQ ID NO: 4417 - protein, 107 aa, Artificial Sequence
  Description of Artificial Sequence: Synthetic polypeptide
EIVLTQSPGTLSLSPGERATLSCRASQSVTSYLAWYQQKPGQAPRLLIYGASSRATGIPDRFSGSGSGTDFTLTISRLDPEDFAVYYCQQYGSSPRTFGQGTKVEIK

SEQ ID NO: 4418 - protein, 9 aa, Artificial Sequence
  Description of Artificial Sequence: Synthetic peptide
QQYGSSPRT

SEQ ID NO: 4419 - protein, 123 aa, Artificial Sequence
  Description of Artificial Sequence: Synthetic polypeptide
QVQLQQWGAGLLKPSETLSLSCAVYGGSLSGYYWSWIRQPPGKGLEWIGEINHFGSTGYNPSLKSRVTISVDTSKSQFSVKLSSVTAADTAVYYCARKPLLYSNLSPGAFDIWGQGTMVTVSS

SEQ ID NO: 4420 - protein, 17 aa, Artificial Sequence
  Description of Artificial Sequence: Synthetic peptide
ARKPLLYSNLSPGAFDI

SEQ ID NO: 4421 - protein, 108 aa, Artificial Sequence
  Description of Artificial Sequence: Synthetic polypeptide
EIVLTQSPGTLSLSPGERATLSCWASQSVSASYLAWYQQKPGQAPRLLIYGASSRATGIPDRFSGSGSGTDFTLTISRLEPEDFAVYYCQQYGTTPRTFGGGTKVEIK

SEQ ID NO: 4422 - protein, 9 aa, Artificial Sequence
  Description of Artificial Sequence: Synthetic peptide
QQYGTTPRT

SEQ ID NO: 4423 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKAGYSYGYPQQYFDYWGQGTLVTVSS

SEQ ID NO: 4424 - protein, 16 aa, Artificial Sequence
  Description of Artificial Sequence: Synthetic peptide
AKAGYSYGYPQQYFDY

SEQ ID NO: 4425 - protein, 107 aa, Artificial Sequence
  Description of Artificial Sequence: Synthetic polypeptide
DIQMTQSPSTLSASVGDRVTITCRASQSISSWLAWYQQKPGKAPKLLISEASSLESGVPSRFSGSGSGTEFTLTISSLQPDDFATYYCQQYNSYSYTFGQGTKLEIK

SEQ ID NO: 4426 - protein, 9 aa, Artificial Sequence
  Description of Artificial Sequence: Synthetic peptide
QQYNSYSYT

SEQ ID NO: 4427 - protein, 118 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTFYADSVKGRFTISSDNSKNTLYLQMNSLRAEDTAVYYCARDLRGPGTFDIWGQGTMVTVSS

SEQ ID NO: 4428 - protein, 12 aa, Artificial Sequence
  Description of Artificial Sequence: Synthetic peptide
ARDLRGPGTFDI

SEQ ID NO: 4429 - protein, 108 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPRVTFGPGTKVDIK

SEQ ID NO: 4430 - protein, 10 aa, Artificial Sequence
  Description of Artificial Sequence: Synthetic peptide
QQYDNLPRVT

SEQ ID NO: 4431 - protein, 118 aa, Artificial Sequence
  Description of Artificial Sequence: Synthetic polypeptide
EVQLVQSGAEVKKPGESLRISCKGSAYIFTTYWISWVRQMPGKGLEWMGRIDPSDSYTNYSPSFQGHVTISADKSISTAYLQWSSLKASDTAMYYCARHISSGWYDYWGQGTLVTVSS

SEQ ID NO: 4432 - protein, 11 aa, Artificial Sequence
  Description of Artificial Sequence: Synthetic peptide
ARHISSGWYDY

SEQ ID NO: 4433 - protein, 106 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSKSGTDFTFTISSLQPEDIATYYCQQYDNLPYTFGQGTKVEI

SEQ ID NO: 4434 - protein, 9 aa, Artificial Sequence
  Description of Artificial Sequence: Synthetic peptide
QQYDNLPYT

SEQ ID NO: 4435 - protein, 123 aa, Artificial Sequence
  Description of Artificial Sequence: Synthetic polypeptide
QMQLVQSGPEVKKPGTSVKVSCKASGFTFTSSAVQWVRQARGQRLEWIGWIVVGSGNTNYVQKFQERVTITRDMSTSTAYMELSSLRSEDTAVYYCAAPHCSSTSCFDAFDIWGQGTMVTVSS

SEQ ID NO: 4436 - protein, 16 aa, Artificial Sequence
  Description of Artificial Sequence: Synthetic peptide
AAPHCSSTSCFDAFDI

SEQ ID NO: 4437 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGNSPWTFGQGTKVEIK

SEQ ID NO: 4438 - protein, 9 aa, Artificial Sequence
  Description of Artificial Sequence: Synthetic peptide
QQYGNSPWT

SEQ ID NO: 4439 - protein, 117 aa, Artificial Sequence
  Description of Artificial Sequence: Synthetic polypeptide
EVQLVESGGGLIQPGGSLRLSCAASGFIVSSNYMSWVRQAPGKGLEWVSIIYSGGSTFYADSVKGRFTISRDNSKNTLYLQMNSLRAEDTAVYYCARTMDGDYFDYWGQGTLVTVSS

SEQ ID NO: 4440 - protein, 11 aa, Artificial Sequence
  Description of Artificial Sequence: Synthetic peptide
ARTMDGDYFDY

SEQ ID NO: 4441 - protein, 107 aa, Artificial Sequence
  Description of Artificial Sequence: Synthetic polypeptide
DIQMTQSPSSLSASVGDRVTITCRASQDINNYLAWYQQKPGKVPKLLIYAASTLQSGVPSRFSGSGSGTDFTLTISSLQPEDVATFYCQKYNSAPLTFGGGTKVEIK

SEQ ID NO: 4442 - protein, 9 aa, Artificial Sequence
  Description of Artificial Sequence: Synthetic peptide
QKYNSAPLT

SEQ ID NO: 4443 - protein, 123 aa, Artificial Sequence
  Description of Artificial Sequence: Synthetic polypeptide
QVQLVESGGGVVQPGRSLRLSCAASGFTFSSYAIHWVRQAPGKGLEWVAVISYDGSNKYYADSVKGRFTISRDNSKNTLYLQMNSLRADDTAVYYCARDSPSQIVVVPVFDYWGQGTLVTVSS

SEQ ID NO: 4444 - protein, 16 aa, Artificial Sequence
  Description of Artificial Sequence: Synthetic peptide
ARDSPSQIVVVPVFDY

SEQ ID NO: 4445 - protein, 108 aa, Artificial Sequence
  Description of Artificial Sequence: Synthetic polypeptide
DIQMTQSPSSLSASVGDRVTITCRASQSISRYLNWYQQKPGKAPNLLIYAASSLQSGVPSRFSGSGSGTDFTLIISSLQPEDFATYYCQQSYSTLALTFGGGTKVEIK

SEQ ID NO: 4446 - protein, 10 aa, Artificial Sequence
  Description of Artificial Sequence: Synthetic peptide
QQSYSTLALT

SEQ ID NO: 4447 - protein, 123 aa, Artificial Sequence
  Description of Artificial Sequence: Synthetic polypeptide
EVQLVESGGGLVQPGRSLRLSCAASGFTFDDYAMHWVRQAPGKGLEWVSGVSWNSGSIGYADSVRGRFTISRDNAKNSLYLQMNSLRAEDTALYYCAKALSSTGFLVVYFDYWGRGTLVTVSS

SEQ ID NO: 4448 - protein, 16 aa, Artificial Sequence
  Description of Artificial Sequence: Synthetic peptide
AKALSSTGFLVVYFDY

SEQ ID NO: 4449 - protein, 108 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWLSLTFGGGTKVEIK

SEQ ID NO: 4450 - protein, 10 aa, Artificial Sequence
  Description of Artificial Sequence: Synthetic peptide
QQYNNWLSLT

SEQ ID NO: 4451 - protein, 128 aa, Artificial Sequence
  Description of Artificial Sequence: Synthetic polypeptide
EVQLVQSGAEVKKPGESLKISCKGSGYRFTSYWIGWVRQMPGKGLEWMGIIYPGDSDATYSPSFQGQVTISADRSISTAYLQWSSLKASDTAMYYCARSFRDDPRIAVAGPADAFDIWGQGTMVTVSS

SEQ ID NO: 4452 - protein, 21 aa, Artificial Sequence
  Description of Artificial Sequence: Synthetic peptide
ARSFRDDPRIAVAGPADAFDI

SEQ ID NO: 4453 - protein, 107 aa, Artificial Sequence
  Description of Artificial Sequence: Synthetic polypeptide
DIQMTQSPSTLSASVGDRATITCRASQSISYWLAWYQQKPGKAPKLLIYKASSLESGVPSRFSGSGSGTEFTLTISSLQPDDSATYYCQQYNSYPYTFGQGTKLEIK

SEQ ID NO: 4454 - protein, 9 aa, Artificial Sequence
  Description of Artificial Sequence: Synthetic peptide
QQYNSYPYT

SEQ ID NO: 4455 - protein, 126 aa, Artificial Sequence
  Description of Artificial Sequence: Synthetic polypeptide
QVQLVQSGAEVKKSGSSVKVSCKASGGTFSSYGISWVRQAPGQGLEWMGGIIPIIGTANYAQKFQGRVTITADESMSTAYMELSSLRSEDTAVYYCARAGLLTKNIVATIGCFDPWGQGTLVTVSS

SEQ ID NO: 4456 - protein, 19 aa, Artificial Sequence
  Description of Artificial Sequence: Synthetic peptide
ARAGLLTKNIVATIGCFDP

SEQ ID NO: 4457 - protein, 113 aa, Artificial Sequence; identical to SEQ ID NO: 1833
  Description of Artificial Sequence: Synthetic polypeptide
  MOD_RES (15)..(15): Any amino acid

SEQ ID NO: 4458 - protein, 9 aa, Artificial Sequence
  Description of Artificial Sequence: Synthetic peptide
QQYYSTPLT

SEQ ID NO: 4459 - protein, 129 aa, Artificial Sequence
  Description of Artificial Sequence: Synthetic polypeptide
QVQLVQSGAEVKKPGASVKVSCKASGYTFTSYGITWVRQAPGQGLQWMGWISAYNGNTNYAQKLQGRVTMTTDTSTSTAYMELRSLRSDDTAVYYCARVGHARGVITGGDYFYYGMDVWGQGTTVTVSS

SEQ ID NO: 4460 - protein, 22 aa, Artificial Sequence
  Description of Artificial Sequence: Synthetic peptide
ARVGHARGVITGGDYFYYGMDV

SEQ ID NO: 4461 - protein, 107 aa, Artificial Sequence
  Description of Artificial Sequence: Synthetic polypeptide
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPTFGGGTKVEIK

SEQ ID NO: 4462 - protein, 8 aa, Artificial Sequence
  Description of Artificial Sequence: Synthetic peptide
QQYGSSPT

SEQ ID NO: 4463 - protein, 127 aa, Artificial Sequence
  Description of Artificial Sequence: Synthetic polypeptide
EVQLLESGGGLVQPGGSLRLSCAASGITFSSYAMTWVRQAPGKGLEWVSTISGSGGGTYYADSVKGRFTISRDNSKNTLYLQMNSLRAEDTAVYYCVETNLWFGEDNYYYYYGMDVWGQGTTVTVSS

SEQ ID NO: 4464 - protein, 20 aa, Artificial Sequence
  Description of Artificial Sequence: Synthetic peptide
VETNLWFGEDNYYYYYGMDV

SEQ ID NO: 4465 - protein, 109 aa, Artificial Sequence
  Description of Artificial Sequence: Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPPWTFGQGTKVEIK

SEQ ID NO: 4466 - protein, 10 aa, Artificial Sequence
  Description of Artificial Sequence: Synthetic peptide
QQYGSSPPWT

SEQ ID NO: 4467 - protein, 117 aa, Artificial Sequence
  Description of Artificial Sequence: Synthetic polypeptide
EVQLVESGGGLIQPGGSLRLSCAASGFIVSSNYMSWVRQAPGKGLEWVSVIYSGGSTYYADSVKGRFTISRDNSKNTLYLQMNSLRAEDTAVYYCARDYGDFYFDYWGQGTLVTVSS

SEQ ID NO: 4468 - protein, 11 aa, Artificial Sequence
  Description of Artificial Sequence: Synthetic peptide
ARDYGDFYFDY

SEQ ID NO: 4469 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYYNWPRTFGQGTKVEIK

SEQ ID NO: 4470 - protein, 9 aa, Artificial Sequence
  Description of Artificial Sequence: Synthetic peptide
QQYYNWPRT

SEQ ID NO: 4471 - protein, 123 aa, Artificial Sequence
  Description of Artificial Sequence: Synthetic polypeptide
QVQLQQWGAGLLKPSETLSLTCAVSGGSLSGFYWTWIRQPPGKGLEWIGETNHFGSTDYKPSLKSRVTISVDMSRNQFSLIMTSVTAADTAVYYCARKTLLFSDFSPGAFDIWGQGTMVVVSS

SEQ ID NO: 4472 - protein, 17 aa, Artificial Sequence
  Description of Artificial Sequence: Synthetic peptide
ARKTLLFSDFSPGAFDI

SEQ ID NO: 4473 - protein, 107 aa, Artificial Sequence
  Description of Artificial Sequence: Synthetic polypeptide
EIVLTQSPGTLSLSPGERATLSCRASQTLTANYLAWYQQKPGQAPRLLIYGASKRATGIPDRFSGSGSGTDFTLSISRLEPEDFAVYYCQQYGTTPRTFGGGTKVEI

SEQ ID NO: 4474 - protein, 9 aa, Artificial Sequence
  Description of Artificial Sequence: Synthetic peptide
QQYGTTPRT

SEQ ID NO: 4475 - protein, 116 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMNSLRADDTAVYYCATDLTSGRGPWGQGTLVTVSS

SEQ ID NO: 4476 - protein, 10 aa, Artificial Sequence
  Description of Artificial Sequence: Synthetic peptide
ATDLTSGRGP

SEQ ID NO: 4477 - protein, 107 aa, Artificial Sequence
  Description of Artificial Sequence: Synthetic polypeptide
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPKTFGQGTKVEIK

SEQ ID NO: 4478 - protein, 9 aa, Artificial Sequence
  Description of Artificial Sequence: Synthetic peptide
LQDYNYPKT

SEQ ID NO: 4479 - protein, 115 aa, Artificial Sequence
  Description of Artificial Sequence: Synthetic polypeptide
EVQLVESGGGLIQPGGSLRLSCAASGLTVSSNYMSWVRQAPGKGLEWVSVIYSGGSTFYADSVKGRFTISRDNSKNTLYLQMNSLRAEDTAVYYCAREVAAFDIWGQGTMVTVSS

SEQ ID NO: 4480 - protein, 9 aa, Artificial Sequence
  Description of Artificial Sequence: Synthetic peptide
AREVAAFDI

SEQ ID NO: 4481 - protein, 107 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPGFGQGTKVEIK

SEQ ID NO: 4482 - protein, 9 aa, Artificial Sequence
  Description of Artificial Sequence: Synthetic peptide
QQLNSYPPG

SEQ ID NO: 4483 - protein, 130 aa, Artificial Sequence
  Description of Artificial Sequence: Synthetic polypeptide
  MOD_RES (76)..(76): Any amino acid
QVQLQESGPGLVKPSQTLSLTCTVSGGSISSGGYYWSWIRQHPGKGLEWIGYIYYSGSTYYNPSLKSRVTISVDTXKNQFSLKLSSVTAADTAVYYCAWRYSSSWYTVDNKKGDYYFDYWGQGTLVTVSS

SEQ ID NO: 4484 - protein, 22 aa, Artificial Sequence
  Description of Artificial Sequence: Synthetic peptide
AWRYSSSWYTVDNKKGDYYFDY

SEQ ID NO: 4485 - protein, 112 aa, Artificial Sequence
  Description of Artificial Sequence: Synthetic polypeptide
DIVMTQSPLSLPVTPGEPASISCRSSESLLHSNGYNYLDWYLQKPGQSPQLLIYLGSNRASGVPDRFSGSGSGTDFTLKISRVEAEDVGVYYCMQALQTPRTFGQGTKLEIK

SEQ ID NO: 4486 - protein, 9 aa, Artificial Sequence
  Description of Artificial Sequence: Synthetic peptide
MQALQTPRT

SEQ ID NO: 4487 - protein, 127 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGRYCSSTSCYSHVGFDPWGQGTLVTVSS

SEQ ID NO: 4488 - protein, 20 aa, Artificial Sequence
  Description of Artificial Sequence: Synthetic peptide
ARGGRYCSSTSCYSHVGFDP

SEQ ID NO: 4489 - protein, 107 aa, Artificial Sequence
  Description of Artificial Sequence: Synthetic polypeptide
DIQLTQSPSFLSASVGDRVTITCRASQGISSYLAWFQQKPGKAPKLLIYAASTLQTGVPSRFSGSGSGTEFTLTISSLQPEDFATYYCQQLNSYPITFGQGTRLEIK

SEQ ID NO: 4490 - protein, 9 aa, Artificial Sequence
  Description of Artificial Sequence: Synthetic peptide
QQLNSYPIT

SEQ ID NO: 4491 - protein, 117 aa, Artificial Sequence; identical to SEQ ID NO: 4415
  Description of Artificial Sequence: Synthetic polypeptide

SEQ ID NO: 4492 - protein, 11 aa, Artificial Sequence
  Description of Artificial Sequence: Synthetic peptide
ARDWGEYYFDY

SEQ ID NO: 4493 - protein, 107 aa, Artificial Sequence; identical to SEQ ID NO: 4417
  Description of Artificial Sequence: Synthetic polypeptide

SEQ ID NO: 4494 - protein, 9 aa, Artificial Sequence
  Description of Artificial Sequence: Synthetic peptide
QQYGSSPRT

SEQ ID NO: 4495 - protein, 129 aa, Artificial Sequence
  Description of Artificial Sequence: Synthetic polypeptide
EVQLVESGGGLVQPGGSLRLSCAASGFTFSSYSMNWVRQAPGKGLEWVSYISTSSSTIYYADSVQGRFTISRDNAKNSLYLQMNSLRDEDTAVYYCARDQGYCSSTSCYDGYYYYMDVWGKGTTVTVSS

SEQ ID NO: 4496 - protein, 22 aa, Artificial Sequence
  Description of Artificial Sequence: Synthetic peptide
ARDQGYCSSTSCYDGYYYYMDV

SEQ ID NO: 4497 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLHSGVPSRFSGSGSGTDFTLTISSLQPEDFATYYCQQSYSAPWTFGQGTKVEIK

SEQ ID NO: 4498 - protein, 9 aa, Artificial Sequence
  Description of Artificial Sequence: Synthetic peptide
QQSYSAPWT

SEQ ID NO: 4499 - protein, 117 aa, Artificial Sequence
  Description of Artificial Sequence: Synthetic polypeptide
EVQLVESGGGLIQPGGSLRLSCAASGFIVSSNYMSWVRQAPGKGLEWVSVIYSGGSTFYADSVKGRFTISRDNSKNTLYLQMNSLRAEDTAVYYCARDYGDYYFDYWGQGTLVTVSS

SEQ ID NO: 4500 - protein, 11 aa, Artificial Sequence
  Description of Artificial Sequence: Synthetic peptide
ARDYGDYYFDY

SEQ ID NO: 4501 - protein, 108 aa, Artificial Sequence; identical to SEQ ID NO: 925
  Description of Artificial Sequence: Synthetic polypeptide

SEQ ID NO: 4502 - protein, 9 aa, Artificial Sequence
  Description of Artificial Sequence: Synthetic peptide
QQYGSSPRT

SEQ ID NO: 4503 - protein, 120 aa, Artificial Sequence; identical to SEQ ID NO: 261
  Description of Artificial Sequence: Synthetic polypeptide

SEQ ID NO: 4504 - protein, 11 aa, Artificial Sequence
  Description of Artificial Sequence: Synthetic peptide
TRWDGWSQHDY

SEQ ID NO: 4505 - protein, 111 aa, Artificial Sequence
  Description of Artificial Sequence: Synthetic polypeptide
DIVMTQSPLSLSVTPGEPASISCRSSQSLLHSNGNNYFDWYLQKPGQSPQLLIYLGSNRASGVPDRFSGSGSGTDFTLKISRVEAEDVGVYYCMQVLQIPYTFGQGTKLEI

SEQ ID NO: 4506 - protein, 9 aa, Artificial Sequence
  Description of Artificial Sequence: Synthetic peptide
MQVLQIPYT

SEQ ID NO: 4507 - protein, 122 aa, Artificial Sequence; identical to SEQ ID NO: 269
  Description of Artificial Sequence: Synthetic polypeptide

SEQ ID NO: 4508 - protein, 15 aa, Artificial Sequence
  Description of Artificial Sequence: Synthetic peptide
ASFHVAYGDYIPFDY

SEQ ID NO: 4509 - protein, 109 aa, Artificial Sequence; identical to SEQ ID NO: 270
  Description of Artificial Sequence: Synthetic polypeptide

SEQ ID NO: 4510 - protein, 10 aa, Artificial Sequence
  Description of Artificial Sequence: Synthetic peptide
QQYGRSPTWT

SEQ ID NO: 4511 - protein, 128 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAREPQINPYYDILTGYRAFDYWGQGTLVTVSS

SEQ ID NO: 4512 - protein, 21 aa, Artificial Sequence
  Description of Artificial Sequence: Synthetic peptide
AREPQINPYYDILTGYRAFDY

SEQ ID NO: 4513 - protein, 107 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGQGTRLEIK

SEQ ID NO: 4514 - protein, 8 aa, Artificial Sequence
  Description of Artificial Sequence: Synthetic peptide
QQYGSSLT

SEQ ID NO: 4515 - protein, 117 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDLGTGLFDYWGQGTLVTVSS

SEQ ID NO: 4516 - protein, 11 aa, Artificial Sequence
  Description of Artificial Sequence: Synthetic peptide
ARDLGTGLFDY

SEQ ID NO: 4517 - protein, 108 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLDSYPPGTFGPGTKVDIK

SEQ ID NO: 4518 - protein, 10 aa, Artificial Sequence
  Description of Artificial Sequence: Synthetic peptide
QQLDSYPPGT

SEQ ID NO: 4519 - protein, 123 aa, Artificial Sequence
  Description of Artificial Sequence: Synthetic polypeptide
QVQLQQWGAGLLKPSETLSLTCAVSGGSLSGFYWTWIRQPPGKGLEWIGETNHFGSTDYKPSLKSRVTISVDMSRNQFSLKVTSVTAADTAVYYCARKPLLHSDLSPGAFDIWGQGTMVAVSS

SEQ ID NO: 4520 - protein, 17 aa, Artificial Sequence
  Description of Artificial Sequence: Synthetic peptide
ARKPLLHSDLSPGAFDI

SEQ ID NO: 4521 - protein, 107 aa, Artificial Sequence
  Description of Artificial Sequence: Synthetic polypeptide
EIVLTQSPGTLSLSPGERATLSCRASQTVSANYLAWYQQKAGQAPRLLIYGASKRATGIPDRFSGSGSGTDFTLSISRLEPEDFAVYYCQQYVTTPRTFGGGTKVEI

SEQ ID NO: 4522 - protein, 9 aa, Artificial Sequence
  Description of Artificial Sequence: Synthetic peptide
QQYVTTPRT

SEQ ID NO: 4523 - protein, 118 aa, Artificial Sequence
  Description of Artificial Sequence: Synthetic polypeptide
EVQLVESGGGLIQPGGSLRLSCAASGFTVSSNYMTWVRQAPGKGLEWVSLIYPGGSTYYADSVKGRFTISRDNSKNTLYLQMNSLRAEDTAVYYCAREGMGMAAAGTWGQGTLVTVSS

SEQ ID NO: 4524 - protein, 12 aa, Artificial Sequence
  Description of Artificial Sequence: Synthetic peptide
AREGMGMAAAGT

SEQ ID NO: 4525 - protein, 107 aa, Artificial Sequence
  Description of Artificial Sequence: Synthetic polypeptide
DIQMTQSPSSLSASVGDTVTITCQASQDISKYLNWYQQKPGKAPKLLIYDASNLETGVPSRFSGSGSGTDFTFTISSLQPEDIATYYCQQYDNLPQTFGGGTKVEIK

SEQ ID NO: 4526 - protein, 9 aa, Artificial Sequence
  Description of Artificial Sequence: Synthetic peptide
QQYDNLPQT

SEQ ID NO: 4527 - protein, 122 aa, Artificial Sequence
  Description of Artificial Sequence: Synthetic polypeptide
EVQLVESGGGLVQPGGSLRLSCAASGFTFSNYDMHWVRQATGRGLEWVSTIGTAGDTYYPGSVKGRFTISRENAKNSLYLQMNSLRAGDTALYYCARVRYDSSGYFWSLDYWGQGTLVTVSS

SEQ ID NO: 4528 - protein, 16 aa, Artificial Sequence
  Description of Artificial Sequence: Synthetic peptide
ARVRYDSSGYFWSLDY

SEQ ID NO: 4529 - protein, 108 aa, Artificial Sequence
  Description of Artificial Sequence: Synthetic polypeptide
DIQMTQSPSSLSASVGDRVTITCRASQSISRYLNWYQQKPGKAPKLLIYAASSLQSGVPSRFSGSGSGTDFTLTISGLQPEDFATYYCQQSYSTPQYTFGQGTKLEIK

SEQ ID NO: 4530 - protein, 10 aa, Artificial Sequence
  Description of Artificial Sequence: Synthetic peptide
QQSYSTPQYT

SEQ ID NO: 4531 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVILYDGSNKYYADSVKGRFTISRDNSKNTLYLQMNSLRAEDTAVYYCAKSLGPYCSGGNCYSSYFDYWGQGTLVTVSS

SEQ ID NO: 4532 - protein, 20 aa, Artificial Sequence
  Description of Artificial Sequence: Synthetic peptide
AKSLGPYCSGGNCYSSYFDY

SEQ ID NO: 4533 - protein, 106 aa, Artificial Sequence
  Description of Artificial Sequence: Synthetic polypeptide
DIQMTQSPSTLSASVGDRVTITCRASQSISSWLAWYQQKPGKAPKLLIYEASSLESGVPSRFSGSGSGTEFTLTISSLQPDDFATYYCQQYNSYSTFGPGTKVDIK

SEQ ID NO: 4534 - protein, 8 aa, Artificial Sequence
  Description of Artificial Sequence: Synthetic peptide
QQYNSYST

SEQ ID NO: 4535 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYGDSVKGRFTISRDNSKNTLYLQMNSLRAEDTAVYYCAKKGGGAYCGGDCYLGEFDYWGQGTLVTVSS

SEQ ID NO: 4536 - protein, 20 aa, Artificial Sequence
  Description of Artificial Sequence: Synthetic peptide
AKKGGGAYCGGDCYLGEFDY

SEQ ID NO: 4537 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVFYCQQYGTSPSTFGQGTKVESK

SEQ ID NO: 4538 - protein, 9 aa, Artificial Sequence
  Description of Artificial Sequence: Synthetic peptide
QQYGTSPST

SEQ ID NO: 4539 - protein, 124 aa, Artificial Sequence
  Description of Artificial Sequence: Synthetic polypeptide
EVQLVESGGGLVQPGRSLRLSCAASGFTFDDYAIHWVRQAPEKGLEWVSGINWSSGSIVYADSVKGRFTISRDNAKNSLYLQMNSLRAEDTALYYCAKGLIAELVGGGWYFDYWGQGTLVTVSS

SEQ ID NO: 4540 - protein, 17 aa, Artificial Sequence
  Description of Artificial Sequence: Synthetic peptide
AKGLIAELVGGGWYFDY

SEQ ID NO: 4541 - protein, 108 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGGGSGTDFTLTISSLEPEDFAVYYCQQRSNWPPLTFGQGTKVEIK

SEQ ID NO: 4542 - protein, 10 aa, Artificial Sequence
  Description of Artificial Sequence: Synthetic peptide
QQRSNWPPLT

SEQ ID NO: 4543 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKQAGPYCSGGTCYPGTLDYWGQGTLVTVSS

SEQ ID NO: 4544 - protein, 20 aa, Artificial Sequence
  Description of Artificial Sequence: Synthetic peptide
AKQAGPYCSGGTCYPGTLDY

SEQ ID NO: 4545 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNVPLTFGPGTKVDIK

SEQ ID NO: 4546 - protein, 9 aa, Artificial Sequence
  Description of Artificial Sequence: Synthetic peptide
QQYDNVPLT

SEQ ID NO: 4547 - protein, 123 aa, Artificial Sequence
  Description of Artificial Sequence: Synthetic polypeptide
QVQLQQWGAGLLKPSETLSLTCAVSGGSLSGFYWTWIRQPPGKGLEWIGETNHFGSTGYKPSLKSRVTISVDMSRNQFSLKVTSVTAADTAVYYCARKPLLYSDFSPGAFDIWGQGTMVAVSS

SEQ ID NO: 4548 - protein, 17 aa, Artificial Sequence
  Description of Artificial Sequence: Synthetic peptide
ARKPLLYSDFSPGAFDI

SEQ ID NO: 4549 - protein, 107 aa, Artificial Sequence
  Description of Artificial Sequence: Synthetic polypeptide
EIVLTQSPGTLSLSPGERATLSCRASQTVTANYLAWYQQKPGQAPRLLIYGASKRATGIPDRFSGSGSGTDFTLSISRLEPEDFAVYYCQQYTTTPRTFGGGTKVEI

SEQ ID NO: 4550 - protein, 9 aa, Artificial Sequence
  Description of Artificial Sequence: Synthetic peptide
QQYTTTPRT

SEQ ID NO: 4551 - protein, 128 aa, Artificial Sequence
  Description of Artificial Sequence: Synthetic polypeptide
EVQLVESGGGLVQPGGSLRLSCAASGFTFSSYDMHWVRQATGKGLEWVSTIGTAGDTYYPGSVKGRFTISRENAKNSLYLQMNSLRAGDTAVYFCARGVSGVVRGVIRSFYYYGLDVWGQGTTVTVSS

SEQ ID NO: 4552 - protein, 22 aa, Artificial Sequence
  Description of Artificial Sequence: Synthetic peptide
ARGVSGVVRGVIRSFYYYGLDV

SEQ ID NO: 4553 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYITPGWTFGQGTKVEIK

SEQ ID NO: 4554 - protein, 10 aa, Artificial Sequence
  Description of Artificial Sequence: Synthetic peptide
QQSYITPGWT

SEQ ID NO: 4555 - protein, 125 aa, Artificial Sequence
  Description of Artificial Sequence: Synthetic polypeptide
EVQLVESGGDLVQPGGSLRLSCAASGFTFSSYSMNWVRQAPGKGLEWVSYISISSSTIYYADSVKGRFTISRDNAKNSLYLQMNSLRDEDTAVYYCARVAIRVVVPSATYYFDYWGQGTLVTVSS

SEQ ID NO: 4556 - protein, 18 aa, Artificial Sequence
  Description of Artificial Sequence: Synthetic peptide
ARVAIRVVVPSATYYFDY

SEQ ID NO: 4557 - protein, 109 aa, Artificial Sequence
  Description of Artificial Sequence: Synthetic polypeptide
EIVLTQSPATLSLSPGERATLSCRASQSFSSYLAWYQQKPGQAPRLLIYDASNRATGIPARFSGSGSGTDFTLTISSLEPEDFAFYYCQQRSNWPQGFTFGPGTKVDIK

SEQ ID NO: 4558 - protein, 11 aa, Artificial Sequence
  Description of Artificial Sequence: Synthetic peptide
QQRSNWPQGFT

SEQ ID NO: 4559 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCATGGGSYFSPRIYFDYWGQGTLVTVSS

SEQ ID NO: 4560 - protein, 16 aa, Artificial Sequence
  Description of Artificial Sequence: Synthetic peptide
ATGGGSYFSPRIYFDY

SEQ ID NO: 4561 - protein, 108 aa, Artificial Sequence; identical to SEQ ID NO: 1201
  Description of Artificial Sequence: Synthetic polypeptide

SEQ ID NO: 4562 - protein, 10 aa, Artificial Sequence
  Description of Artificial Sequence: Synthetic peptide
QQYDNLPPYT

SEQ ID NO: 4563 - protein, 120 aa, Artificial Sequence
  Description of Artificial Sequence: Synthetic polypeptide
EVQLVESGGGLIKPGRSLRLSCTASGFTFGDYAMTWFRQAPGKGLEWVGFIRSKAYGGTTGYAASVRYRFTISRDDSSGIAYLQMDSLKTEDTAVYYCTRWDGWSQHDYWGQGTLVTVSS

SEQ ID NO: 4564 - protein, 11 aa, Artificial Sequence
  Description of Artificial Sequence: Synthetic peptide
TRWDGWSQHDY

SEQ ID NO: 4565 - protein, 111 aa, Artificial Sequence
  Description of Artificial Sequence: Synthetic polypeptide
DIVMTQSPLSLPVTPGEPASISCRSSQSLLQSNGNNYFDWYLQKPGQSPQLLIYLGSNRASGVPDRFSGSGSGTDFTLKISRVEAEDVGVYYCMQVLQVPYTFGQGTNLEI

SEQ ID NO: 4566 - protein, 9 aa, Artificial Sequence
  Description of Artificial Sequence: Synthetic peptide
MQVLQVPYT

SEQ ID NO: 4567 - protein, 118 aa, Artificial Sequence
  Description of Artificial Sequence: Synthetic polypeptide
EVQLVESGGGLIQPGGSLRLSCAASGFTVSSNYMSWVRQAPGKGLEWVSLIYPGGSTYFADSVKGRFTISRDNSKNTLYLQMNSLRAEDTAVYYCAREGMGIAAAGTWGQGTLVTVSS

SEQ ID NO: 4568 - protein, 12 aa, Artificial Sequence
  Description of Artificial Sequence: Synthetic peptide
AREGMGIAAAGT

SEQ ID NO: 4569 - protein, 107 aa, Artificial Sequence; identical to SEQ ID NO: 4525
  Description of Artificial Sequence: Synthetic polypeptide

SEQ ID NO: 4570 - protein, 9 aa, Artificial Sequence
  Description of Artificial Sequence: Synthetic peptide
QQYDNLPQT

SEQ ID NO: 4571 - protein, 120 aa, Artificial Sequence; identical to SEQ ID NO: 305
  Description of Artificial Sequence: Synthetic polypeptide

SEQ ID NO: 4572 - protein, 13 aa, Artificial Sequence
  Description of Artificial Sequence: Synthetic peptide
AKSWWLSENWFDP

SEQ ID NO: 4573 - protein, 107 aa, Artificial Sequence; identical to SEQ ID NO: 306
  Description of Artificial Sequence: Synthetic polypeptide

SEQ ID NO: 4574 - protein, 9 aa, Artificial Sequence
  Description of Artificial Sequence: Synthetic peptide
QQYNNWPLT

SEQ ID NO: 4575 - protein, 117 aa, Artificial Sequence
  Description of Artificial Sequence: Synthetic polypeptide
EVQLVESGGGLIQPGGSLRLSCAASGFTVSSNYMTWVRQAPGKGLEWVSVIYSGGTTYYADSVKGRFTISRDNSKNTLYLQMNSLRAEDTAVYYCARDLVVWGMDVWGQGTTVTVSS

SEQ ID NO: 4576 - protein, 11 aa, Artificial Sequence
  Description of Artificial Sequence: Synthetic peptide
ARDLVVWGMDV

SEQ ID NO: 4577 - protein, 107 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQLLNSYPYTFGQGTKLEIK

SEQ ID NO: 4578 - protein, 9 aa, Artificial Sequence
  Description of Artificial Sequence: Synthetic peptide
QLLNSYPYT

SEQ ID NO: 4579 - protein, 123 aa, Artificial Sequence
  Description of Artificial Sequence: Synthetic polypeptide
QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPYCSGGSCSDAFDIWGQGTMVTVSS

SEQ ID NO: 4580 - protein, 16 aa, Artificial Sequence
  Description of Artificial Sequence: Synthetic peptide
AAPYCSGGSCSDAFDI

SEQ ID NO: 4581 - protein, 108 aa, Artificial Sequence; identical to SEQ ID NO: 2257
  Description of Artificial Sequence: Synthetic polypeptide

SEQ ID NO: 4582 - protein, 9 aa, Artificial Sequence
  Description of Artificial Sequence: Synthetic peptide
QQYGSSPWT

SEQ ID NO: 4583 - protein, 128 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYMQWSSLKASDTAMYYCARSFRDDPRIAVAGPADAFDIWGQGTMVTVSS

SEQ ID NO: 4584 - protein, 21 aa, Artificial Sequence
  Description of Artificial Sequence: Synthetic peptide
ARSFRDDPRIAVAGPADAFDI

SEQ ID NO: 4585 - protein, 107 aa, Artificial Sequence
  Description of Artificial Sequence: Synthetic polypeptide
DIQMTQSPSTLSASVGDRVTITCRASQSISYWLAWYQQKPGKAPKLLIYQASSLESGVPSRFSGSESGTEFTLTISSLQPDDFATYYCQQYNSYPYTFGQGTKLEIK

SEQ ID NO: 4586 - protein, 9 aa, Artificial Sequence
  Description of Artificial Sequence: Synthetic peptide
QQYNSYPYT

SEQ ID NO: 4587 - protein, 117 aa, Artificial Sequence
  Description of Artificial Sequence: Synthetic polypeptide
EVQLVESGGGLIQPGGSLRLSCAASGFIVSSNYMSWVRQAPGKGLEWVSVIYSGGSTFYTDSVKGRFTISRDNSKNTLYLQMNSLRAEDTAVYYCVRDYGDFYFDYWGQGTLVTVSS

SEQ ID NO: 4588 - protein, 11 aa, Artificial Sequence
  Description of Artificial Sequence: Synthetic peptide
VRDYGDFYFDY

SEQ ID NO: 4589 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGGGSETDFTLTISRLEPEDCAVYYCQQYGSSPRTFGQGTKVEIK

SEQ ID NO: 4590 - protein, 9 aa, Artificial Sequence
  Description of Artificial Sequence: Synthetic peptide
QQYGSSPRT

SEQ ID NO: 4591 - protein, 117 aa, Artificial Sequence
  Description of Artificial Sequence: Synthetic polypeptide
EVQLVESGGGLIQPGGSLRLSCAASGFTVSYNYMSWVRQAPGKGLEWVSIIYSGGSTYYADSVKGRFTISRDNSKNTLYLQMNSLRAEDTAIYYCARDYGDLYFDYWGQGTLVTVSS

SEQ ID NO: 4592 - protein, 11 aa, Artificial Sequence
  Description of Artificial Sequence: Synthetic peptide
ARDYGDLYFDY

SEQ ID NO: 4593 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTRLEIK

SEQ ID NO: 4594 - protein, 9 aa, Artificial Sequence
  Description of Artificial Sequence: Synthetic peptide
QQYGSSPRT

SEQ ID NO: 4595 - protein, 128 aa, Artificial Sequence
  Description of Artificial Sequence: Synthetic polypeptide
EVQLVESGGGLVQPGGSLKLSCAASGFTFSGSAMHWVRQASGKGLEWVGRIRSKANSYATTYAASVKGRFTISRDDSKNTAYLQMNSLKTEDTAVYYCTKPHAHCGGDCYSRDWFDPWGQGTLVTVSS

SEQ ID NO: 4596 - protein, 19 aa, Artificial Sequence
  Description of Artificial Sequence: Synthetic peptide
TKPHAHCGGDCYSRDWFDP

SEQ ID NO: 4597 - protein, 108 aa, Artificial Sequence
  Description of Artificial Sequence: Synthetic polypeptide
DIQMTQSPSSLSASVGDRVTITCRASQSISSYLYWYQQKPGKAPKLLIYAASSLQSGVPSRFSGSGSGTDFTLTISSLQPEDFATYYCQQSYSTPPFTFGPGTKVDIK

SEQ ID NO: 4598 - protein, 10 aa, Artificial Sequence
  Description of Artificial Sequence: Synthetic peptide
QQSYSTPPFT

SEQ ID NO: 4599 - protein, 1273 aa, Severe acute respiratory syndrome coronavirus 2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 4600 - protein, 8 aa, Artificial
  Synthetic
GYSFTSYW

SEQ ID NO: 4601 - protein, 8 aa, Artificial
  Synthetic
IYPGDSDT

SEQ ID NO: 4602 - protein, 12 aa, Artificial
  Synthetic
ARGVAVDWYFDL

SEQ ID NO: 4603 - protein, 9 aa, Artificial
  Synthetic
SSNIGAGYD

SEQ ID NO: 4604 - protein, 3 aa, Artificial
  Synthetic
GNS

SEQ ID NO: 4605 - protein, 12 aa, Artificial
  Synthetic
QSYDSSLSALYV

SEQ ID NO: 4606 - protein, 8 aa, Artificial
  Synthetic
GFGVRNNY

SEQ ID NO: 4607 - protein, 7 aa, Artificial
  Synthetic
IYSGGTT

SEQ ID NO: 4608 - protein, 25 aa, Artificial
  Synthetic
AREGDVEGFSDLWSGYSRDRYYFDY

SEQ ID NO: 4609 - protein, 9 aa, Artificial
  Synthetic
SSDVGGYNY

SEQ ID NO: 4610 - protein, 3 aa, Artificial
  Synthetic
DVT

SEQ ID NO: 4611 - protein, 10 aa, Artificial
  Synthetic
SSFTSSNTRV

SEQ ID NO: 4612 - protein, 8 aa, Artificial
  Synthetic
GFSVSTKY

SEQ ID NO: 4613 - protein, 7 aa, Artificial
  Synthetic
LYSGRTD

SEQ ID NO: 4614 - protein, 23 aa, Artificial
  Synthetic
ARDSSEVRDHPGHPGRSVGAFDI

SEQ ID NO: 4615 - protein, 9 aa, Artificial
  Synthetic
SNDVGSYTL

SEQ ID NO: 4616 - protein, 3 aa, Artificial
  Synthetic
EDS

SEQ ID NO: 4617 - protein, 10 aa, Artificial
  Synthetic
CSYAGSHTFV

SEQ ID NO: 4618 - protein, 8 aa, Artificial
  Synthetic
GYSFTIYW

SEQ ID NO: 4619 - protein, 8 aa, Artificial
  Synthetic
IYPGDSDT

SEQ ID NO: 4620 - protein, 12 aa, Artificial
  Synthetic
ARGVAVDWYFDL

SEQ ID NO: 4621 - protein, 9 aa, Artificial
  Synthetic
SSNIGAGFD

SEQ ID NO: 4622 - protein, 3 aa, Artificial
  Synthetic
GNN

SEQ ID NO: 4623 - protein, 12 aa, Artificial
  Synthetic
QSSGSVLSDLYV

SEQ ID NO: 4624 - protein, 9 aa, Artificial
  Synthetic
GGSISSNNW

SEQ ID NO: 4625 - protein, 7 aa, Artificial
  Synthetic
IYHSGST

SEQ ID NO: 4626 - protein, 15 aa, Artificial
  Synthetic
ARGGDTAMGPEYFDY

SEQ ID NO: 4627 - protein, 9 aa, Artificial
  Synthetic
SSDVGGYNY

SEQ ID NO: 4628 - protein, 3 aa, Artificial
  Synthetic
DVS

SEQ ID NO: 4629 - protein, 10 aa, Artificial
  Synthetic
SSYTSSSTLL

SEQ ID NO: 4630 - protein, 8 aa, Artificial
  Synthetic
GFSVSTKY

SEQ ID NO: 4631 - protein, 7 aa, Artificial
  Synthetic
LYSGGSD

SEQ ID NO: 4632 - protein, 23 aa, Artificial
  Synthetic
ARDSSEVRDHPGHPGRSVGAFDI

SEQ ID NO: 4633 - protein, 9 aa, Artificial
  Synthetic
SNDVGSYTL

SEQ ID NO: 4634 - protein, 3 aa, Artificial
  Synthetic
EGT

SEQ ID NO: 4635 - protein, 10 aa, Artificial
  Synthetic
CSYAGASTFV

SEQ ID NO: 4636 - protein, 8 aa, Artificial
  Synthetic
GFTVSNNY

SEQ ID NO: 4637 - protein, 7 aa, Artificial
  Synthetic
IYSGGST

SEQ ID NO: 4638 - protein, 25 aa, Artificial
  Synthetic
AREGEVEGYNDFWSGYSRDRYYFDY

SEQ ID NO: 4639 - protein, 9 aa, Artificial
  Synthetic
SSDVGGYNY

SEQ ID NO: 4640 - protein, 3 aa, Artificial
  Synthetic
DVS

SEQ ID NO: 4641 - protein, 10 aa, Artificial
  Synthetic
SSYTSSSTRV

SEQ ID NO: 4642 - protein, 8 aa, Artificial
  Synthetic
GFSVSTKY

SEQ ID NO: 4643 - protein, 7 aa, Artificial
  Synthetic
LYSGGSD

SEQ ID NO: 4644 - protein, 23 aa, Artificial
  Synthetic
ARDSSEVRDHPGHPGRSVGAFDI

SEQ ID NO: 4645 - protein, 9 aa, Artificial
  Synthetic
SNDVGSYTL

SEQ ID NO: 4646 - protein, 3 aa, Artificial
  Synthetic
EVT

SEQ ID NO: 4647 - protein, 10 aa, Artificial
  Synthetic
CSYAGASTFV

SEQ ID NO: 4648 - protein, 9 aa, Artificial
  Synthetic
AGSISSNNW

SEQ ID NO: 4649 - protein, 7 aa, Artificial
  Synthetic
VYHNGNI

SEQ ID NO: 4650 - protein, 15 aa, Artificial
  Synthetic
AKGGDRAMGPEYFDS

SEQ ID NO: 4651 - protein, 9 aa, Artificial
  Synthetic
SSDVGANNY

SEQ ID NO: 4652 - protein, 3 aa, Artificial
  Synthetic
DVN

SEQ ID NO: 4653 - protein, 10 aa, Artificial
  Synthetic
SSFASSSTLL

SEQ ID NO: 4654 - protein, 8 aa, Artificial
  Synthetic
GGTFSSYA

SEQ ID NO: 4655 - protein, 8 aa, Artificial
  Synthetic
IIPIFGTA

SEQ ID NO: 4656 - protein, 19 aa, Artificial
  Synthetic
ARREAYGPRDYYYYYGMDV

SEQ ID NO: 4657 - protein, 5 aa, Artificial
  Synthetic
SGYSN

SEQ ID NO: 4658 - protein, 8 aa, Artificial
  Synthetic
VGTGGIVG

SEQ ID NO: 4659 - protein, 13 aa, Artificial
  Synthetic
GADQGSGSNFVGV

SEQ ID NO: 4660 - protein, 8 aa, Artificial
  Synthetic
GGTFSTSA

SEQ ID NO: 4661 - protein, 8 aa, Artificial
  Synthetic
IIPFFGTP

SEQ ID NO: 4662 - protein, 19 aa, Artificial
  Synthetic
ARREPYGPRDYYYFFGMDV

SEQ ID NO: 4663 - protein, 7 aa, Artificial
  Synthetic
SDYSYYK

SEQ ID NO: 4664 - protein, 8 aa, Artificial
  Synthetic
VGPGGIVG

SEQ ID NO: 4665 - protein, 13 aa, Artificial
  Synthetic
GADEGSGGTFVGV

What is claimed is:

1. An isolated anti-SARS-CoV-2 antibody or antigen-binding fragment thereof that binds specifically to a SARS-CoV-2 antigen, comprising HCDR1, HCDR2, HCDR3, LCDR1, LCDR2, and LCDR3 comprising respective amino acid sequences of (a) SEQ ID NOs: 4600, 4601, 4602, 4603, 4604, and 4605; (b) SEQ ID NOs: 4606, 4607, 4608, 4609, 4610, and 4611; (c) SEQ ID Nos: 4612, 4613, 4614, 4615, 4616, and 4617; (d) SEQ ID NOs: 4618, 4619, 4620, 4621, 4622, and 4623; (e) SEQ ID NOs: 4624, 4625, 4626, 4627, 4628, and 4629; (f) SEQ ID NOs: 4630, 4631, 4632, 4633, 4634, and 4635; (g) SEQ ID NOs: 4642, 4643, 4644, 4645, 4646, and 4647; (h) SEQ ID NOs: 4648, 4649, 4650, 4651, 4652, and 4653; (i) SEQ ID NOs: 4654, 4655, 4656, 4657, 4658, and 4659; or (j) SEQ ID NOs: 4660, 4661, 4662, 4663, 4664, and 4665.

2. An isolated anti-SARS-CoV-2 antibody or antigen-binding fragment thereof that binds specifically to a SARS-CoV-2 antigen, comprising a heavy chain variable region and a light chain variable region that comprise the respective amino acid sequences of SEQ ID NOs: 3-4, 11-12, 141-142, 143-144, 189-190, 311-312, 313-314, 315-316, 317-318, 319-320, or 321-322.

3. The antibody or antigen-binding fragment thereof of claim 1, wherein the antibody or antigen-binding fragment thereof is a multivalent antibody comprising (a) a first target binding site that specifically binds to an epitope within the S polypeptide, and (b) a second target binding site that binds to an epitope on a different epitope on the S polypeptide or a different molecule.

4. The antibody or antigen-binding fragment thereof of claim 3, wherein the multivalent antibody is a bivalent or bispecific antibody.

5. The antibody or the antigen-binding fragment thereof of claim 1, further comprising an Fc region or a variant Fc region.

6. The antibody or antigen-binding fragment thereof of claim 1, wherein the antibody is a monoclonal antibody.

7. The antibody or antigen-binding fragment thereof of claim 1, wherein the antibody is a chimeric antibody, a humanized antibody, or humanized monoclonal antibody.

8. The antibody or antigen-binding fragment thereof of claim 1, wherein the antibody is a single-chain antibody, a Fab fragment, or a Fab2 fragment.

9. A pharmaceutical composition comprising the antibody or antigen-binding fragment thereof of claim 1 and a pharmaceutically acceptable carrier or excipient.

10. The pharmaceutical composition of claim 9, wherein the pharmaceutical comprises two or more of the antibody or antigen-binding fragment thereof of claim 1.

11. The pharmaceutical composition of claim 9, further comprising an additional therapeutic agent.

12. The pharmaceutical composition of claim 11, wherein the additional therapeutic agent comprises an anti-inflammatory drug or an antiviral compound.

13. The pharmaceutical composition of claim 12, wherein the antiviral compound comprises: a nucleoside analog, a peptoid, an oligopeptide, a polypeptide, a protease inhibitor, a 3C-like protease inhibitor, a papain-like protease inhibitor, or an inhibitor of an RNA dependent RNA polymerase.

14. A nucleic acid molecule encoding a polypeptide chain of the antibody or antigen-binding fragment thereof of claim 1.

15. A vector comprising the nucleic acid molecule of claim 14.

16. A cultured host cell comprising the vector of claim 15.

17. A method of preparing an antibody, or antigen-binding portion thereof, comprising:

obtaining the cultured host cell of claim 16;

culturing the cultured host cell in a medium under conditions permitting expression of a polypeptide encoded by the vector and assembling of an antibody or fragment thereof; and purifying the antibody or fragment from the cultured cell or the medium of the cell.

18. A kit comprising a pharmaceutically acceptable dose unit of the antibody or antigen-binding fragment thereof of claim 1.

19. A kit for the diagnosis, prognosis or monitoring the treatment of SARS-CoV-2 infection in a subject, comprising: the antibody or antigen-binding fragment thereof of claim 1; and at least one detection reagent that binds specifically to the antibody or antigen-binding fragment thereof.

20. A method of neutralizing SARS-CoV-2 in a subject, comprising administering to a subject in need thereof a therapeutically effective amount of the antibody or antigen-binding fragment thereof of claim 1.

21. A method of preventing or treating a SARS-CoV-2 infection, comprising administering to a subject in need thereof a therapeutically effective amount of the antibody or antigen-binding fragment thereof of claim 1.

22. A method of neutralizing SARS-CoV-2 in a subject, comprising administering to a subject in need thereof a therapeutically effective amount of a first antibody or antigen-binding fragment thereof and a second antibody or antigen-binding fragment thereof of claim 1, wherein the first antibody or antigen-binding fragment thereof and the second antibody or antigen binding fragment thereof exhibit synergistic activity.

23. A method of preventing or treating a SARS-CoV-2 infection, comprising administering to a subject in need thereof a therapeutically effective amount of a first antibody or antigen-binding fragment thereof and a second antibody or antigen-binding fragment thereof of claim 1, wherein the first antibody or antigen-binding fragment thereof and the second antibody or antigen binding fragment thereof exhibit synergistic activity.

24. The method of claim 20, further comprising administering to the subject a therapeutically effective amount of an additional therapeutic agent or therapy.

25. The method of claim 22, wherein the first antibody or antigen-binding fragment thereof is administered before, after, or concurrently with the second antibody or antigen-binding fragment thereof.

26. The method of claim 25, wherein the second therapeutic agent comprises an anti-inflammatory drug or an antiviral compound.

27. The method of claim 26, wherein the antiviral compound comprises: a nucleoside analog, a peptoid, an oligopeptide, a polypeptide, a protease inhibitor, a 3C-like protease inhibitor, a papain-like protease inhibitor, or an inhibitor of an RNA dependent RNA polymerase.

28. The method of claim 20, wherein the antibody or antigen-binding fragment thereof is administered to the subject intravenously, subcutaneously, or intraperitoneally.

29. The method of claim 20, wherein the antibody or antigen-binding fragment thereof is administered prophylactically or therapeutically.

30. A method for detecting the presence of SARS CoV-2 in a sample comprising:

contacting a sample with the antibody or antigen-binding fragment thereof of claim 1; and determining binding of the antibody or antigen-binding fragment to one or more SARS CoV-2 antigens, wherein binding of the antibody to the one or more SARS CoV-2 antigens is indicative of the presence of SARS CoV-2 in the sample.

31. The method of claim 30, wherein the SARS-CoV-2 antigen comprises the receptor-binding domain (RBD) of the S polypeptide.

32. The method of claim 31, wherein the RBD comprises amino acids 319-541 of the S polypeptide.

33. The method of claim 30, wherein the antibody or antigen-binding fragment thereof is conjugated to a label.

* * * * *